US009481889B2

(12) United States Patent
Singh et al.

(10) Patent No.: US 9,481,889 B2
(45) Date of Patent: Nov. 1, 2016

(54) GENE CONTROLLING SHELL PHENOTYPE IN PALM

(71) Applicant: Malaysian Palm Oil Board, Kajang (MY)

(72) Inventors: Rajinder Singh, Kuala Lumpur (MY); Leslie Low Eng Ti, Kuala Lumpur (MY); Leslie Ooi Cheng Li, Kuala Lumpur (MY); Meilina Ong Abdullah, Seremban (MY); Rajanaidu Nookiah, Kuala Lumpur (MY); Ravigadevi Sambanthamurthi, Selangor (MY); Steven W. Smith, Fitchburg, WI (US); Nathan D. Lakey, Chesterfield, MO (US); Rob Martienssen, Cold Spring Harbor, NY (US); Jared Ordway, St. Louis, MO (US); Michael Hogan, Ballwin, MO (US)

(73) Assignee: THE MALASIAN PALM OIL BOARD, Kajang (MY)

( * ) Notice: Subject to any disclaimer, the term of this patent is extended or adjusted under 35 U.S.C. 154(b) by 675 days.

(21) Appl. No.: 13/800,652

(22) Filed: Mar. 13, 2013

(65) Prior Publication Data
US 2013/0247249 A1 Sep. 19, 2013

Related U.S. Application Data

(60) Provisional application No. 61/612,885, filed on Mar. 19, 2012.

(51) Int. Cl.
*A01H 5/08* (2006.01)
*A01H 1/04* (2006.01)
*C12N 15/82* (2006.01)
*C07K 14/415* (2006.01)
*C12Q 1/68* (2006.01)

(52) U.S. Cl.
CPC ............ *C12N 15/8261* (2013.01); *A01H 1/04* (2013.01); *C07K 14/415* (2013.01); *C12N 15/8247* (2013.01); *C12Q 1/6895* (2013.01); *C12Q 2600/156* (2013.01)

(58) Field of Classification Search
None
See application file for complete search history.

(56) References Cited

U.S. PATENT DOCUMENTS

| | | |
|---|---|---|
| 5,310,893 A | 5/1994 | Erlich et al. |
| 5,451,512 A | 9/1995 | Apple et al. |
| 5,468,613 A | 11/1995 | Erlich et al. |
| 5,604,099 A | 2/1997 | Erlich et al. |
| 6,307,123 B1 | 10/2001 | Kriz et al. |
| 6,646,264 B1 | 11/2003 | Modiano et al. |
| 6,880,771 B2 | 4/2005 | Deppermann |
| 7,367,155 B2 | 5/2008 | Kotyk et al. |
| 7,402,731 B2 | 7/2008 | Penner et al. |
| 7,454,989 B2 | 11/2008 | Deppermann |
| 7,600,642 B2 | 10/2009 | Deppermann |
| 7,673,572 B2 | 3/2010 | Deppermann et al. |
| 7,685,768 B2 | 3/2010 | Deppermann |
| 7,909,276 B2 | 3/2011 | Deppermann et al. |
| 7,998,669 B2 | 8/2011 | Deppermann et al. |
| 8,076,076 B2 | 12/2011 | Osborn et al. |
| 8,221,968 B2 | 7/2012 | Becker et al. |
| 8,237,016 B2 | 8/2012 | Ye et al. |
| 8,241,914 B2 | 8/2012 | Durack et al. |
| 8,281,935 B2 | 10/2012 | Deppermann |
| 8,312,672 B2 | 11/2012 | Deppermann et al. |
| 8,362,317 B2 | 1/2013 | Calabotta et al. |
| 8,401,271 B2 | 3/2013 | Deppermann et al. |
| 8,443,545 B2 | 5/2013 | Deppermann et al. |
| 2004/0110142 A1 | 6/2004 | Bennett et al. |
| 2008/0000815 A1 | 1/2008 | Deppermann |
| 2008/0289061 A1 | 11/2008 | Penner et al. |
| 2009/0070891 A1 | 3/2009 | Foley et al. |
| 2010/0143906 A1 | 6/2010 | Becker et al. |
| 2011/0079544 A1 | 4/2011 | Hunger et al. |
| 2011/0132721 A1 | 6/2011 | Kevin et al. |
| 2011/0195866 A1 | 8/2011 | Deppermann et al. |
| 2012/0117865 A1 | 5/2012 | Deppermann et al. |
| 2012/0180386 A1 | 7/2012 | Deppermann et al. |
| 2013/0079917 A1 | 3/2013 | Deppermann et al. |
| 2013/0104454 A1 | 5/2013 | Deppermann et al. |

FOREIGN PATENT DOCUMENTS

| | | |
|---|---|---|
| EP | 0 235 726 A2 | 9/1987 |
| WO | 89/11548 A1 | 11/1989 |
| WO | 95/00119 A1 | 1/1995 |
| WO | 03/040369 A2 | 5/2003 |
| WO | 2010/056107 A2 | 5/2010 |
| WO | 2010/146357 A1 | 12/2010 |
| WO | 2011/119390 A1 | 9/2011 |
| WO | 2011/119394 A1 | 9/2011 |

OTHER PUBLICATIONS

Barcelos et al. (Pesq. agropec. bras., Brasilia, v. 37, n. 8, p. 1105-1114, 2002).*
Billotte et al. (Theor Appl Genet (2005) 110: 754-765).*
Arias, "Genetic Similarity Among Commercial Oil Palm Materials Based on Microsatellite Markers", Agronomia Colombiana, vol. 30, No. 2, pp. 188-195 (2012). Retrieved from http://www.bdigital.unai.edu.co/30352/1/29152-156322-2-PB.pdf.
Conner et al., "Detection of sickle cell beta S-globin allele by hybridization with oligonucleotides", Proc. Natl. Acad. Sci. USA, 80:278-282 (1983).

(Continued)

Primary Examiner — Elizabeth McElwain
Assistant Examiner — Charles Logsdon
(74) Attorney, Agent, or Firm — Kilpatrick Townsend & Stockton LLP

(57) ABSTRACT

Nucleic acid sequences for predicting and controlling shell phenotype in palm.

20 Claims, 7 Drawing Sheets

(56) References Cited

OTHER PUBLICATIONS

Gill et al., "Nucleic Acid Isothermal Amplification Technologies—A Review", *Nucleosides, Nucleotides, and Nucleic Acids*, 27: 224-43 (2008).

Mayes et al., "The use of Molecular Markers to Investigate the Genetic Structure of an Oil Palm Breeding Programme", Heredity (edinb) vol. 85, Part 3, pp. 288-293, PMID: 11012733 (2000).

Notomi et al., "Loop-mediated isothermal amplification of DNA", *Nucleic Acids Research*, 28(12), e63 i-vii, (2000).

Saiki et al., "Analysis of enzymaticaly amplified beta-globin and HLA-DQ alpha DNA with allele-specific oligonucleotide probes", *Nature*, 324: 163-166, (1986).

Seng et al., "Genetic Linkage Map of a High Yielding FELDS Deli x Yangambi Oil Palm Cross", Plos One, vol. 6, No. 11, e26593 (2011).

Singh et al., "Mapping Quantitative Trait Loci (QTLs) for Fatty Acid Composition in an Interspecific Cross of Oil Palm", BMC Plant Biol., vol. 9, pp. 114 (2009).

Stoneking et al., "Population variation of human mtDNA control region sequences detected by enzymatic amplification and sequence-specific oligonucleotide probes", *Am. J. Hum. Genet.* 48:370-382, 1991.

Walbot, Genomic Sequences Found Using Engineered RescueMu Transpson, National Center for Biotechnology Infomration, Genbank accession BH891314 (2001). Retrieved from http://www.ncbi.him.nih.gov/nucgss/222227?report=genbank.

International Search Report and Written Opinion dated Dec. 12, 2014 for International Patent Application No. PCT/US2014/047171, 11 pages.

The Intenrational Search Report and Written Opinion from PCT/US2013/030803, dated Jun. 14, 2013.

Adam et al.; "MADS Box Genes in Oil Palm (*Elaeis guineensis*): Patterns in the Evolution of the *Squamosa, Deficiens, Globosa, Agamous* and *Sepallata* Subfamilies"; *J. Mol. Evol.*; 62:15-31 (2006).

Billotte et al.; "Microsatellite-based high density linkage map in oil palm (*Elaeis guineensis* Jacq.)"; *Theor. Appl. Genet.*; 110:754-765 (2005).

Billotte et al.; "QTL detection by multi-parent linkage mapping in oil palm (*Elaeis guineensis* Jacq.)"; *Theor. Appl. Genet.*; 120:1673-7687(2010).

Moertzsohn et al.; "RAPD linkage mapping the shell thickness locus in palm oil (*Elaeis guineensis* Jacq.)"; *Theor. Appl. Genet.*; 100:63-70 (2000).

Singh et al.; "Identification of cDNA-RFLP Markers and Their Use for Molecular Mapping Oil Palm (*Elaeis guineensis*)"; *Asia Pacific Journal of Molecular Biology and Biotechnology*; 16(3):53-63 (2008).

\* cited by examiner

GENE CONTROLLING SHELL PHENOTYPE IN PALM

CROSS-REFERENCE TO RELATED PATENT APPLICATIONS

The present patent application claims benefit of priority to U.S. Provisional Patent Application No. 61/612,885, filed Mar. 19, 2012, which is incorporated by reference for all purposes.

BACKGROUND OF THE INVENTION

The oil palm (*E. guineensis* and *E. oleifera*) can be classified into separate groups based on its fruit characteristics, and has three naturally occurring fruit types which vary in shell thickness and oil yield. *Dura* type palms are homozygous for a wild type allele of the shell gene ($sh^+/sh^+$), have a thick seed coat or shell (2-8 mm) and produce approximately 5.3 tons of oil per hectare per year. *Tenera* type palms are heterozygous for a wild type and mutant allele of the shell gene ($sh^+/sh^-$), have a relatively thin shell surrounded by a distinct fiber ring, and produce approximately 7.4 tons of oil per hectare per year. Finally, *pisifera* type palms are homozygous for a mutant allele of the shell gene ($sh^-/sh^-$), have no seed coat or shell, and are usually female sterile (Hartley, 1988) (Table 1). Therefore, the inheritance of the single gene controlling shell phenotype is a major contributor to palm oil yield.

*Tenera* palms are hybrids between the *dura* and *pisifera* palms. Whitmore (1973) described the various fruit forms as different varieties of oil palm. However, Latiff (2000) was in agreement with Purseglove (1972) that varieties or cultivars as proposed by Whitmore (1973), do not occur in the strict sense in this species. As such, Latiff (2000) proposed the term "race" to differentiate *dura*, *pisifera* and *tenera*. Race was considered an appropriate term as it reflects a permanent microspecies, where the different races are capable of exchanging genes with one another, which has been adequately demonstrated in the different fruit forms observed in oil palm (Latiff, 2000). In fact, the characteristics of the three different races turn out to be controlled simply by the inheritance of a single gene. Genetic studies revealed that the shell gene shows co-dominant monogenic inheritance, which is exploitable in breeding programmes (Beirnaert and Vanderweyen, 1941).

The shell gene responsible for this phenotype was first reported in the Belgian Congo in the 1940's (Beirnaert and Venderweyan, 1941). However, *tenera* fruit forms were recognized and exploited in Africa well before then (Devuyst, 1953; Godding, 1930; Sousa et al., 2011). Given the central role played by the shell gene, oil palm breeding utilizes reciprocal recurrent selection of maternal (*dura*) and paternal (*pisifera*) pools using the North Carolina Model 1 maize breeding design (Rajanaidu et al., 2000). The Deli *dura* population, direct descendants of the four original African palms planted in Bogor Botanical Garden, Indonesia (1848), has excellent combining ability with the AVROS (Algemene Vereniging van Rubberplanters ter Oostkust van Sumatra) and other *pisifera* parental palms. AVROS *pisifera* palms were derived from the famous "Djongo" palm from Congo, but more recently several different accessions of *dura* and *pisifera* have also been sourced from Africa (Rajanaidu et al. 2000).

*Tenera* fruit types have a higher mesocarp to fruit ratio, which directly translates to significantly higher oil yield than either the *dura* or *pisifera* palm (as illustrated in Table 1).

TABLE 1

Comparison of dura, tenera and pisifera fruit forms

| | Fruit Form | | |
|---|---|---|---|
| Characteristic | Dura | Tenera | Pisifera* |
| Shell thickness (mm) | 2-8 | 0.5-3 | Absence of shell |
| Fibre Ring ** | Absent | Present | Absent |
| Mesocarp Content (% fruit weight) | 35-55 | 60-96 | 95 |
| Kernel Content (% fruit weight) | 7-20 | 3-15 | 3-5 |
| Oil to Bunch (%) | 16 | 26 | — |
| Oil Yield (t/ha/yr) | 5.3 | 7.4 | — |

*usually female sterile, bunches rot prematurely
** fibre ring is present in the mesocarp and often used as diagnostic tool to differentiate dura and tenera palms.
(Source: Hardon et al., 1985; Hartley, 1988)

Since the crux of the breeding programmes in oil palm is to produce planting materials with higher oil yield, the *tenera* palm is the preferred choice for commercial planting. It is for this reason that substantial resources are invested by commercial seed producers to cross selected *dura* and *pisifera* palms in hybrid seed production. And despite the many advances which have been made in the production of hybrid oil palm seeds, two significant problems remain in the seed production process. First, batches of *tenera* seeds, which will produce the high oil yield *tenera* type palm, are often contaminated with *dura* seeds (Donough and Law, 1995). Today, it is estimated that *dura* contamination of *tenera* seeds can reach rates of approximately 5% (reduced from as high as 20-30% in the early 1990's as the result of improved quality control practices). Seed contamination is due in part to the difficulties of producing pure *tenera* seeds in open plantation conditions, where workers use ladders to manually pollinate tall trees, and where palm flowers for a given bunch mature over a period time, making it difficult to pollinate all flowers in a bunch with a single manual pollination event. Some flowers of the bunch may have matured prior to manual pollination and therefore may have had the opportunity to be wind pollinated from an unknown tree, thereby producing contaminant seeds in the bunch. Alternatively premature flowers may exist in the bunch at the time of manual pollination, and may mature after the pollination occurred allowing them to be wind pollinated from an unknown tree thereby producing contaminant seeds in the bunch. Prior to the invention described herein, it was not possible to identify the fruit type of a given seed of a given plant arising from a seed until it matured enough to produce a first batch of fruit, which typically takes approximately six years after germination. Notably, in the four to five years interval from germination to fruit production, significant land, labor, financial and energy resources are invested into what are believed to be *tenera* trees, some of which will ultimately be of the unwanted low yielding contaminant fruit types. By the time these suboptimal trees are identified, it is impractical to remove them from the field and replace them with *tenera* trees, and thus growers achieve lower palm oil yields for the 25 to 30 year production life of the contaminant trees. Therefore, the issue of contamination of batches of *tenera* seeds with *dura* or *pisifera* seeds is a problem for oil palm breeding, underscoring the need for a method to predict the fruit type of seeds and nursery plantlets with high accuracy.

A second problem in the seed production process is the investment seed producers make in maintaining *dura* and *pisifera* lines, and in the other expenses incurred in the hybrid seed production process. Prior to the present invention, there was no know way to produce a tree with an optimal shell phenotype which when crossed to itself or to another tree with optimal shell phenotype would produce seeds which would only generate optimal shell phenotypes. Therefore, there is a need to engineer trees to breed true from one generation to the next for optimal shell phenotype.

The genetic mapping of the shell gene was initially attempted by Mayes et al. (1997). A second group in Brazil, using a combination of bulked segregation analysis (BSA) and genetic mapping, reported two random amplified polymorphic DNA (RAPD) markers flanking the shell locus (Moretzsohn et al., 2000). More recently, Billotte et al., (2005) reported a simple sequence repeat (SSR)-based high density linkage map for oil palm, involving a cross between a thin shelled *E. guineensis* (*tenera*) palm and a thick shelled *E. guineensis* (*dura*) palm. A patent filed by the Malaysian Palm Oil Board (MPOB) describes the identification of a marker using restriction fragment technology, in particular a Restriction Fragment Length Polymorphism (RFLP) marker linked to the shell gene for plant identification and breeding purposes (RAJINDER SINGH, LESLIE OOI CHENG-LI, RAHIMAH A, RAHMAN AND LESLIE LOW ENG TI. 2008. Method for identification of a molecular marker linked to the shell gene of oil palm. Patent Application No. PI 20084563. Patent Filed on 13 Nov. 2008). The RFLP marker (SFB 83) was identified by way of generation or construction of a genetic map for a *tenera* fruit type palm.

BRIEF SUMMARY OF THE INVENTION

In this patent, we describe the genetic mapping and identification of the shell gene responsible for the different fruit forms and methods for determining the shell phenotype of a palm plant (including but not limited to a whole palm plant or palm seed). We used homozygosity mapping by sequencing to overcome challenges posed by phenotyping experimental populations, and we found two independent mutations in the DNA binding domain of an oil palm MADS-box gene substantially similar to *Arabidopsis* SEEDSTICK (STK), also referred to as AGAMOUS-like 11 (AGL11), as well as to *Arabidopsis* SHATTERPROOF (SHP1), also referred to as AGAMOUS-like 1 (AGL1). For brevity, herein we refer to the shell gene as SHELL. We demonstrate that SHELL is responsible for the shell phenotype in both cultivated and wild palms from sub-Saharan Africa. Furthermore, our findings provide a genetic explanation for the single gene heterosis attributed to SHELL. This is the first demonstration of a gene mutation explaining an economic trait in oil palm, and has important implications for the competing interests of global edible oil production, biofuels and rainforest conservation (Danielsen et al., 2009).

In some embodiments, methods for determining the shell phenotype of a palm (e.g., oil palm) plant (including but not limited to a whole palm plant or palm seed) are provided. In some embodiments, the method comprises, providing a sample from the plant or seed; and determining from the sample the genotype of at least one polymorphic marker in the genomic region corresponding to SEQ ID NO:8218, wherein heterozygosity within the region indicates the presence of the *tenera* shell phenotype. In some embodiments, the plant or seed is generated from i) a cross between a plant having the *dura* shell phenotype and a plant having the *pisifera* shell phenotype, ii) the selfing of a *tenera* palm, iii) a cross between two plants having the *tenera* shell phenotype, iv) a cross between a plant having the *dura* shell phenotype and a plant having the *tenera* shell phenotype, or v) a cross between a plant having the *tenera* shell phenotype and a plant having the *pisifera* shell phenotype. In some embodiments, the plant is less than 5 years old. In some embodiments, the plant is less than one year old.

In some embodiments, the polymorphic marker is within a position in the genomic region corresponding to SEQ ID NO:8219. In some embodiments, the polymorphic marker is within 1, 10, 20, 50, 100, 200, 500, 1000, 200, 3000 kb from a position in the genomic region corresponding to SEQ ID NO:8219. In some embodiments, the polymorphic marker is at least 86, 88, 90, 92, 94, 96, 97, 98, or 99% predictive of the *tenera* phenotype.

In some embodiments, the method further comprises selecting the seed or plant for cultivation if the plant is heterozygous for the polymorphic marker. In some embodiments, the plants or seeds are discarded if the plants or seeds do not have a genotype predictive of the *tenera* shell phenotype.

Also provided is a method for segregating a plurality of palm (e.g., oil palm) plants into different categories based on predicted shell phenotype. In some embodiments, the method comprises, providing a sample from each plant in the plurality of plants; determining from the samples the genotype of at least one polymorphic marker in the genetic region corresponding to SEQ ID NO:8218; and segregating the plants into groups based on the genotype of the polymorphic marker, wherein the groups correspond to plants predicted to have the *tenera* shell phenotype, plants predicted to have the *dura* shell phenotype, and plants predicted to have the *pisifera* shell phenotype.

Also provided are kits for determining the shell phenotype of a palm seed or plant. In some embodiments, the kit comprises, one or more oligonucleotide primer or probe that comprises:

a sequence of at least, e.g., 6, 7, 8, 9, 10, 11, 12, 13, 14, 15, 16, 17, or 18 (or 20, 22, 24, or more) nucleotides of SEQ ID NO:8218; or;

a sequence 100% complementary to at least e.g., 6, 7, 8, 9, 10, 11, 12, 13, 14, 15, 16, 17, or 18 (or 20, 22, 24, or more) nucleotides of SEQ ID NO:8218.

In some embodiments, the primer or probe specifically hybridizes to palm plant DNA or RNA.

In some embodiments, the primer or probe comprises:

a sequence of at least, e.g., 6, 7, 8, 9, 10, 11, 12, 13, 14, 15, 16, 17, or 18 (or 20, 22, 24, or more) nucleotides of SEQ ID NO:8219; or;

a sequence 100% complementary to at least, e.g., 6, 7, 8, 9, 10, 11, 12, 13, 14, 15, 16, 17, or 18 (or 20, 22, 24, or more) nucleotides of SEQ ID NO:8219.

In some embodiments, a detectable label is linked to the oligonucleotide. In some embodiments, the detectable label is fluorescent.

In some embodiments, the kit further comprises a polynucleotide encoding a polypeptide comprising a sequence substantially (e.g., a least 80, 85, 90, 95, 97, 98, 99%) identical or identical to SEQ ID NO:8220, 8221, or 8222.

Also provided is an isolated nucleic acid comprising a polynucleotide encoding a polypeptide comprising a sequence substantially (e.g., a least 80, 85, 90, 95, 97, 98, 99%) identical or identical to SEQ ID NO:8220, 8221, or 8222.

Also provided is a cell or seed or plant comprising a heterologous expression cassette, the expression cassette comprising a heterologous promoter operably linked to a polynucleotide encoding a polypeptide comprising a sequence substantially (e.g., a least 80, 85, 90, 95, 97, 98, 99%) identical or identical to SEQ ID NO:8220, 8221, or 8222. In some embodiments, the seed or plant is a palm (e.g., oil palm) seed or palm (e.g., oil palm) plant. In some embodiments, the polypeptide comprises SEQ ID NO:8220, 8221, or 8222. In some embodiments, the heterologous promoter results in expression level of an RNA encoding the polypeptide in the seed or plant that is less than, equal to, or more than expression of an endogenous SHELL RNA in the seed or plant. In some embodiments, the seed or plant comprises two *pisifera* alleles of an endogenous SHELL gene. In some embodiments, the seed or plant makes mature shells that are on average less than 2 mm thick.

Also provided is a cell or seed or plant comprising a heterologous expression cassette, the expression cassette comprising a promoter operably linked to a polynucleotide, which polynucleotide, when expressed in the seed or plant, reduces expression of a SHELL polypeptide in the seed or plant (compared to a control plant lacking the expression cassette), wherein reduced expression of the SHELL polypeptide results in reduced shell thickness of the future seeds produced by the plant.

In some embodiments, the polynucleotide comprises at least 20 contiguous nucleotides, or the complement thereof, of an endogenous nucleic acid encoding a SHELL polypeptide substantially (e.g., a least 80, 85, 90, 95, 97, 98, 99%) identical or identical to SEQ ID NO:8220, 8221, or 8222, such that expression of the polynucleotide inhibits expression of the endogenous SHELL gene. In some embodiments, the polynucleotide comprises a sequence at least 80% identical to at least 100 contiguous nucleotides, or the complement thereof, of an endogenous nucleic acid encoding a SHELL polypeptide substantially (e.g., a least 80, 85, 90, 95, 97, 98, 99%) identical or identical to SEQ ID NO:8220, 8221, or 8222, such that expression of the polynucleotide inhibits expression of the endogenous SHELL gene. In some embodiments, the polynucleotide encodes an siRNA, antisense polynucleotide, a microRNA, or a sense suppression nucleic acid, thereby suppressing expression of an endogenous SHELL gene. In some embodiments, the seed or plant makes mature shells that are on average less than 2 mm thick.

Also provided is a plant comprising a heterologous expression cassette, the expression cassette comprising a promoter operably linked to a polynucleotide encoding a polypeptide comprising a SHELL M, I, and K domain but lacks a functional C domain. In some embodiments, the polypeptide comprises an amino acid sequence substantially (e.g., a least 80, 85, 90, 95, 97, 98, 99%) identical or identical to the palm SHELL polypeptide. In some embodiments, the polypeptide comprises a non-functional C domain. In some embodiments, the plant is a palm plant. In some embodiments, the palm plant is in the *dura* background.

Also provided is a method of making a plant as described above or elsewhere herein, comprising introducing the expression cassette into a plant.

Also provided is a method of cultivating the plants described herein.

Other embodiments will be evident from reading the rest of the disclosure.

DEFINITIONS

A "shell phenotype" refers to the three fruit forms of *E. guineensis*—*dura, tenera* and *pisifera* caused by the presence or absence of the shell or the thickness of the shell.

A "polymorphic marker" refers to a genetic marker that distinguishes between two alleles.

A genomic region "corresponding to" a test sequence refers to a genomic DNA that aligns with the test sequence. It is generally expected that a plant genome will have only one genomic region (i.e., a locus represented by two alleles in a diploid plant) corresponding to the test sequence. To the extent more than one genomic region from a plant can be aligned to the test sequence, the "corresponding" genomic region is the genomic region with the highest percent of identical nucleotides. Sequence comparisons can be performed using any BLAST™ including BLAST 2.2 algorithm with default parameters, described in Altschul et al., *Nuc. Acids Res.* 25:3389 3402 (1977) and Altschul et al., *J. Mol. Biol.* 215:403 410 (1990), respectively.

As used herein, the terms "nucleic acid," "polynucleotide" and "oligonucleotide" refer to nucleic acid regions, nucleic acid segments, primers, probes, amplicons and oligomer fragments. The terms are not limited by length and are generic to linear polymers of polydeoxyribonucleotides (containing 2-deoxy-D-ribose), polyribonucleotides (containing D-ribose), and any other N-glycoside of a purine or pyrimidine base, or modified purine or pyrimidine bases. These terms include double- and single-stranded DNA, as well as double- and single-stranded RNA.

A nucleic acid, polynucleotide or oligonucleotide can comprise, for example, phosphodiester linkages or modified linkages including, but not limited to phosphotriester, phosphoramidate, siloxane, carbonate, carboxymethylester, acetamidate, carbamate, thioether, bridged phosphoramidate, bridged methylene phosphonate, phosphorothioate, methylphosphonate, phosphorodithioate, bridged phosphorothioate or sulfone linkages, and combinations of such linkages.

A nucleic acid, polynucleotide or oligonucleotide can comprise the five biologically occurring bases (adenine, guanine, thymine, cytosine and uracil) and/or bases other than the five biologically occurring bases.

Optimal alignment of sequences for comparison may be conducted by the local homology algorithm of Smith and Waterman *Add. APL. Math.* 2:482 (1981), by the homology alignment algorithm of Needle man and Wunsch *J. Mol. Biol.* 48:443 (1970), by the search for similarity method of Pearson and Lipman *Proc. Natl. Acad. Sci.* (*U.S.A.*) 85: 2444 (1988), by computerized implementations of these algorithms (GAP, BESTFIT, BLAST™, FASTA, and TFASTA in the Wisconsin Genetics Software Package, Genetics Computer Group (GCG), 575 Science Dr., Madison, Wis.), or by inspection.

"Percentage of sequence identity" is determined by comparing two optimally aligned sequences over a comparison window, wherein the portion of the polynucleotide sequence in the comparison window may comprise additions or deletions (i.e., gaps) as compared to the reference sequence (which does not comprise additions or deletions) for optimal alignment of the two sequences. The percentage is calculated by determining the number of positions at which the identical nucleic acid base or amino acid residue occurs in both sequences to yield the number of matched positions, dividing the number of matched positions by the total number of positions in the window of comparison and multiplying the result by 100 to yield the percentage of sequence identity.

The term "substantial identity" of polypeptide sequences means that a polypeptide comprises a sequence that has at least 75% sequence identity. Alternatively, percent identity can be any integer from 75% to 100%. Exemplary embodiments include at least: 75%, 80%, 85%, 90%, 95%, or 99% compared to a reference sequence using the programs described herein; preferably BLAST™ using standard parameters, as described below. One of skill will recognize that these values can be appropriately adjusted to determine corresponding identity of proteins encoded by two nucleotide sequences by taking into account codon degeneracy, amino acid similarity, reading frame positioning and the like. Polypeptides which are "substantially similar" share sequences as noted above except that residue positions which are not identical may differ by conservative amino acid changes. Conservative amino acid substitutions refer to the interchangeability of residues having similar side chains. For example, a group of amino acids having aliphatic side chains is glycine, alanine, valine, leucine, and isoleucine; a group of amino acids having aliphatic-hydroxyl side chains is serine and threonine; a group of amino acids having amide-containing side chains is asparagine and glutamine; a group of amino acids having aromatic side chains is phenylalanine, tyrosine, and tryptophan; a group of amino acids having basic side chains is lysine, arginine, and histidine; and a group of amino acids having sulfur-containing side chains is cysteine and methionine. Preferred conservative amino acids substitution groups are: valine-leucine-isoleucine, phenylalanine-tyrosine, lysine-arginine, alanine-valine, aspartic acid-glutamic acid, and asparagine-glutamine.

Another indication that nucleotide sequences are substantially identical is if two molecules hybridize to each other, or a third nucleic acid, under stringent conditions. Stringent conditions are sequence dependent and will be different in different circumstances. Generally, stringent conditions are selected to be about 5° C. lower than the thermal melting point (Tm) for the specific sequence at a defined ionic strength and pH. The Tm is the temperature (under defined ionic strength and pH) at which 50% of the target sequence hybridizes to a perfectly matched probe. Typically, stringent conditions will be those in which the salt concentration is about 0.02 molar at pH 7 and the temperature is at least about 60° C.

The term "promoter" or "regulatory element" refers to a region or sequence determinants located upstream or downstream from the start of transcription and which are involved in recognition and binding of RNA polymerase and other proteins to initiate transcription. Promoters need not be of plant origin, for example, promoters derived from plant viruses, such as the CaMV35S promoter, can be used.

The term "plant" includes whole plants, shoot vegetative organs/structures (e.g. leaves, stems and tubers), roots, flowers and floral organs/structures (e.g. bracts, sepals, petals, stamens, carpels, anthers and ovules), seed (including embryo, endosperm, and seed coat) and fruit (the mature ovary), plant tissue (e.g. vascular tissue, ground tissue, and the like) and cells (e.g. guard cells, egg cells, trichomes and the like), and progeny of same. The class of plants that can be used in the method of the invention is generally as broad as the class of higher and lower plants amenable to transformation techniques, including angiosperms (monocotyledonous and dicotyledonous plants), gymnosperms, ferns, and multicellular algae. It includes plants of a variety of ploidy levels, including aneuploid, polyploid, diploid, haploid and hemizygous.

An "expression cassette" refers to a nucleic acid construct, which when introduced into a host cell, results in transcription and/or translation of a RNA or polypeptide, respectively. Antisense constructs or sense constructs that are not or cannot be translated are expressly included by this definition.

The term "operably linked" refers to a functional linkage between a nucleic acid expression control sequence (such as a promoter, or array of transcription factor binding sites) and a second nucleic acid sequence, wherein the expression control sequence directs transcription of the nucleic acid corresponding to the second sequence.

A polynucleotide sequence is "heterologous to" an organism or a second polynucleotide sequence if it originates from a foreign species, or, if from the same species, is modified from its original form. For example, a heterologous promoter operably linked to a coding sequence refers to a promoter from a species different from that from which the coding sequence was derived, or, if from the same species, a promoter which is different from any naturally occurring allelic variants.

Tenera Allele Angola, Madagascar, Nigeria (371), Tanzania=SEQ ID NO:8226, Nigeria (Palm T128)=SEQ ID NO:8227. Nigeria (88)=SEQ ID NO:8228.

Figure 6:
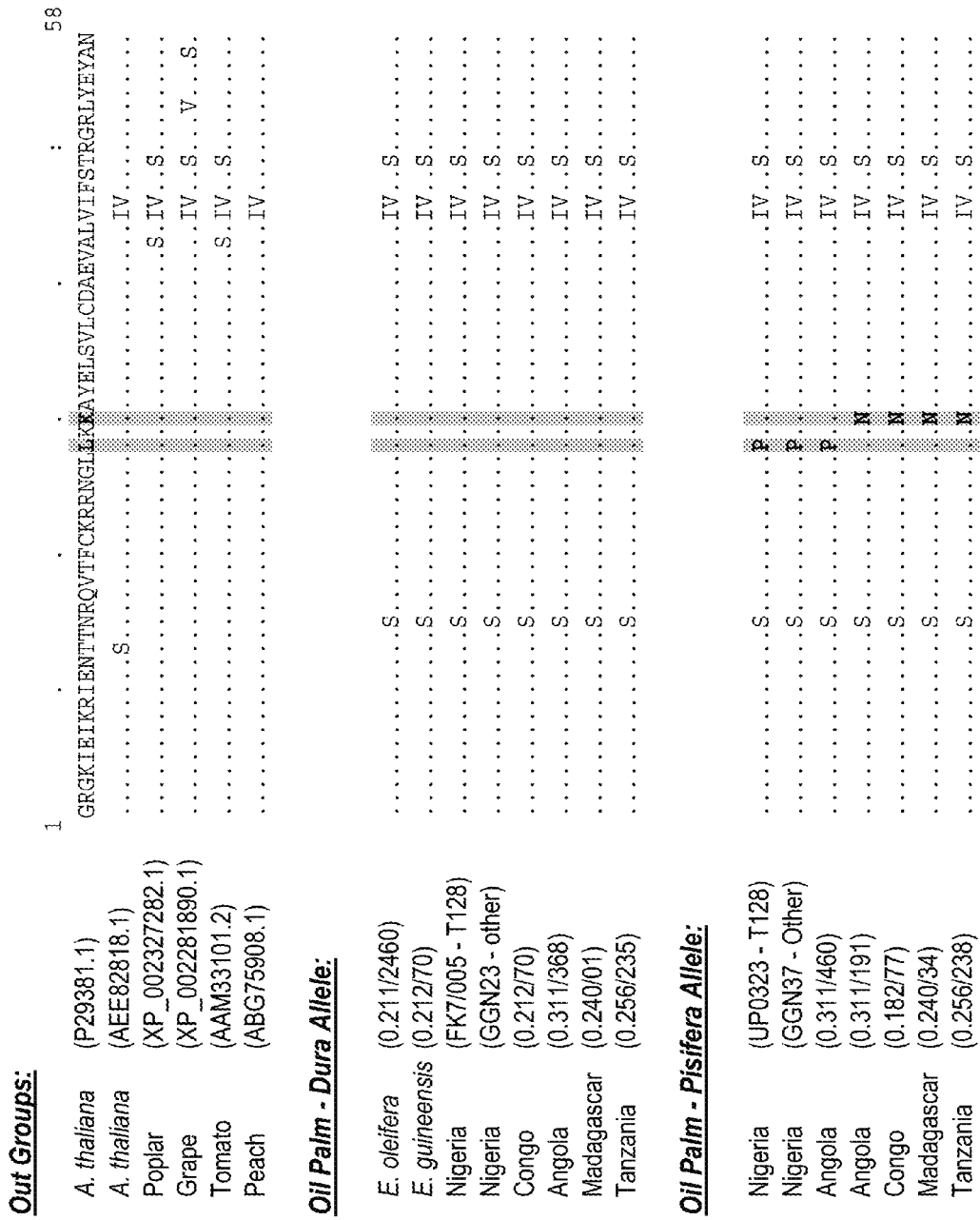

FIG. 6. Protein sequence of the MADS domain, amino acid substitutions in *pisifera* palms and expression of shell. a, Multiple sequence alignment of *Arabidopsis* SHP (P29381.1; SEQ ID NO:8229) and STK (AEE828 18.1; SEQ ID NO:8230) proteins, poplar predicted protein (XP_002327282.1; SEQ ID NO:8231), grape MADS-box protein 5 (XP_002281890.1; SEQ ID NO:8232), tomato TAGL1 (AAM33101.2; SEQ ID NO:8231) and peach SHATTERPROOF-like (ABG75908.1; SEQ ID NO:8233) (Out Groups), *E. oleifera, E. guineensis* and exemplars of Deli *dura* (Oil Palm—*Dura* Allele) (SEQ ID NO:8234), and exemplars of *pisifera* from T128—Nigerian and AVROS— Congo (Oil Palm—*Pisifera* Allele). The *pisifera* fruit form is caused by two disruptive SNPs (SEQ ID NOS:8235 and 8236) that affect a highly conserved amino acid motif in the MADS box DNA binding and dimerization domain. Sequence accession numbers (out group examples) or sample identifiers (oil palm examples) are in parentheses.

Figure 7:
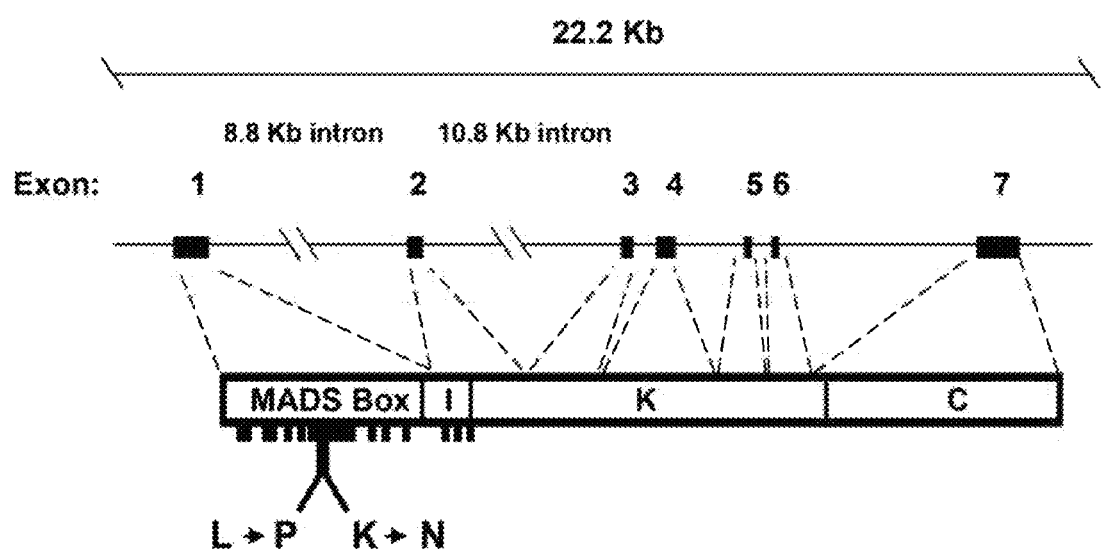

FIG. 7. SHELL gene model. Exons (boxes) and introns (horizontal lines) were validated by RNA-seq. A diagram of protein domains encoded by the indicated exons is provided below the gene diagram. MADS box, I, K and C domains of the SHELL protein are indicated. The locations of mutated amino acids (L to P and K to N) in the MADS box domain are highlighted. The location of conserved residues involved in DNA binding and/or MADS box protein homo- or heterodimerization are indicated by vertical marks below the MADS box and I domains.

DETAILED DESCRIPTION OF THE INVENTION

I. Introduction

The present disclosure describes the construction of a dense genetic map for a selfed *tenera* palm, designated T128 from MPOB's Nigerian germplasm collection. The position of the shell locus was determined on the genetic map. The markers located on the linkage group containing the shell gene were used to pull out the genome scaffolds generated from whole genome DNA sequencing of *pisifera* corresponding to the linkage group. The gene linked to the shell locus was subsequently identified in the genome scaffold. Disclosed herein, the gene responsible for fruit shell type is substantially similar to *Arabidopsis* SEEDSTICK (STK), also referred to as AGAMOUS-like 11 (AGL11), as well as to *Arabidopsis* SHATTERPROOF (SHP1), also referred to as AGAMOUS-like 1 (AGL1). For brevity, herein we refer to the shell gene as SHELL. Two independent mutations in the DNA binding domain of this type II MADS-box transcription factor gene were identified and validated in 336 individual oil palms, one occurring in the *pisifera* collected from Nigeria and the other occurring in the *pisifera* collected from Zaire. The genotype at either of these two positions explains 96.7% of the fruit shell phenotypes of the 336 sample population (148 *tenera*, 100 *pisifera*, 86 *dura* and 2 with unknown phenotypes). In total, the SHELL genotype was discordant with the fruit type phenotype in only 11 palms (3 *tenera*, 2 *pisifera* and 6 *dura*) of the 334 that had phenotypes. The 3.3% discordance rate is within the range of the rate of incorrect phenotyping or genotyping based on either questionable fruit type classification or collection of samples from unintended trees in the field, respectively (approximately 5%). This represents the first demonstration of a gene mutation explaining an important economic trait in oil palm. Furthermore, the findings provide a genetic explanation for the single gene heterosis characteristic of the fruit shell phenotype, and they have implications in oil palm breeding and commercial seed production.

A polymorphic marker closely linked to the shell gene character, or the identification of the shell gene itself and the use of a polymorphic marker located within the gene itself, is of significant commercial importance, as it can be used by seed producers as a quality control tool to i) reduce or eliminate *dura* or *pisifera* contamination of *tenera* seed or plantlets, and ii) positively identify *tenera* seeds or plantlets which are then selected as suitable planting material for commercial palm oil production. The identification of the shell gene or a marker genetically linked to shell trait is also of importance in breeding programmes. The marker or the alleles of the gene responsible for the trait can be used to separate the *dura, tenera* and *pisifera* plants in the nursery; the advantage here being that they could be planted separately based on shell phenotype. This is of interest as the *pisifera* palms usually show very vigorous vegetative growth, so in a trial consisting of all three types, distortion of results could occur due to intra-cross competition. Furthermore, separating out the *pisifera* palms and planting them in high density encourages male inflorescence and this facilitates pollen production which is used in breeding programmes (Jack et al. 1998). Accordingly, following detection of the presence or absence of *dura, pisifera*, or *tenera* SHELL genotype, or a linked marker as described below, a further step of: (1) reduction elimination of *dura* or *pisifera* contamination of *tenera* seed or plantlets, (2) positive identification of *tenera* seeds or plantlets which are then selected as suitable planting material for commercial palm oil production, or (3) separating *dura, tenera* and *pisifera* plants into two or more groups (e.g., plants predicted to be *tenera* in one group and plants predicted to be *dura* or *pisifera* in a second group; plants predicted to be *dura* in one group and plants predicted to be *tenera* or *pisifera* in a second group; plants predicted to be *pisifera* in one group and plants predicted to be *dura* or *tenera* in a second group, or separating into three groups: *dura, pisifera,* and *tenera*) with can be achieved.

Any marker that exists that is polymorphic between the parent *dura* and *pisifera* trees in a cross and is linked to the shell locus has the potential to serve as a molecular signal to identify *tenera* trees in a cross. For example, if a *dura* tree, which is homozygous for "T" (i.e., T/T) at a given SNP position near the shell locus is crossed with a *pisifera* tree that is homozygous for "A" (i.e., A/A) at the same SNP position, then one could genotype seeds of the cross, or one could genotype plantlets arising from seeds of the cross, at the SNP position to track and identify contaminant seeds or plantlets. Seeds that are determined to be heterozygous at the SNP position, (i.e., A/T) are very likely to be *tenera*, unless a recombination between the marker and the shell gene had occurred in the individual being genotyped. Similarly, seeds which are homozygous at the SNP position for "A" or "T", (i.e., A/A or T/T), are *pisifera* or *dura* contaminant trees respectively, and when these trees become sexually mature in several years, they will produce suboptimal fruit types. Additionally, seeds or plantlets which have a "C" or "G" in the SNP position, neither of which is present in paternal palm of the cross, are likely trees arising from a different pollen donor than the one intended in the cross, and therefore can be discarded as contaminant seeds or plantlets. Markers that are in closer proximity to the shell locus would have higher predictive accuracy than markers that are farther away from the shell locus, because the closer the marker is to the shell gene, the less likely a recombination could occur which would break the linkage between the marker and the shell gene. Consequently, polymorphic markers within the shell gene itself are expected to have the strongest predictive power, and analysis of multiple markers closely linked to or within the shell gene may be advantageous.

II. Determination of Shell Phenotype Based on Nucleic Acid Detection

In view of the discovery that the SHELL genotype segregates with the *tenera/pisifera/dura* shell phenotype, genotyping a plant or seed at the SHELL locus or at adjacent genomic regions can be used to predict the shell phenotype of a palm plant.

SEQ ID NO:8220 represents the predicted amino acid sequence of the N-terminal 181 amino acids of the protein expressed in oil palm of the *dura* fruit type. The endogenous protein includes additional C-terminal amino acids not included in SEQ ID NO:8220. In oil palm of the *dura* fruit type, the proteins derived from both alleles of the gene include a leucine (L) amino acid at the $28^{th}$ amino acid position and a lysine (K) amino acid at the $30^{th}$ amino acid position.

SEQ ID NO:8221 represents the predicted amino acid sequence of the N-terminal 18 amino acids of the protein expressed in oil palm of the *pisifera* fruit type that is derived from the Zaire line. The endogenous protein includes additional C-terminal amino acids not included in SEQ ID NO:8221. This polypeptide includes a leucine (L) amino acid at the $28^{th}$ amino acid position and an asparagine (N) amino acid at the $30^{th}$ amino acid position.

SEQ ID NO:8222 represents the predicted amino acid sequence of the N-terminal 181 amino acids of the protein expressed in oil palm of the *pisifera* fruit type that is derived from the Nigerian line. The endogenous protein includes additional C-terminal amino acids not included here. This polypeptide includes a proline (P) amino acid at the $28^{th}$ amino acid position and a lysine (K) at the $30^{th}$ amino acid position.

Oil palm trees of the *pisifera* fruit type are the result of one of at least three possibilities: i) both alleles coding for the SEQ ID NO:8221 protein sequence, ii) both alleles coding for the SEQ ID NO:8222 protein sequence, or iii) one allele coding for the SEQ ID NO:8221 protein sequence and the other allele coding for the SEQ ID NO:8222 protein sequence.

Oil palm trees of the *tenera* fruit type are the result of one of at least two possibilities: i) one allele coding for the SEQ ID NO:8220 protein sequence and the other allele coding for the SEQ ID NO:8221 protein sequence, or ii) one allele coding for the SEQ ID NO:8220 protein sequence and the other allele coding for the SEQ ID NO:8222 protein sequence.

It will be appreciated that SEQ ID NOS:8220, 8221, and 8222 are representative sequences and that different individual palms may have an amino acid sequence having one or more amino acid changes relative to SEQ ID NOS:8220, 8221, and 8222 due, for example, to natural variation.

One or more polymorphism(s) between *pisifera* and *dura* SHELL alleles can be used to determine the shell phenotype of a palm or other plant. For example, when the polymorphism is co-dominant (detectable independent of the other allele) then:

the presence of only a *dura* SHELL allele indicates that the plant has or will have a *dura* shell phenotype;

the presence of only a *pisifera* SHELL allele indicates that the plant has or will have a *pisifera* shell phenotype; and the presence of a *pisifera* SHELL allele and a *dura* SHELL allele indicates that the plant has or will have a *tenera* shell phenotype.

SEQ ID NO:922 and 923 represent SNPs (single nucleotide polymorphisms) corresponding to those within the SHELL gene sequence itself.

However, genomic regions adjacent to the SHELL gene are also useful to determining whether a palm plant will likely manifest a particular shell phenotype. Because of genetic linkage to the SHELL gene, polymorphisms adjacent to the SHELL locus are predictive of shell phenotype, albeit with reduced accuracy as a function of increased distance from the SHELL locus. SEQ ID NO:8218 provides an approximately 3.4 MB genomic region of the palm genome that comprises the SHELL gene. Table A provides a listing of more than 8200 SNPs identified within SEQ ID NO:8218. A small selection of the SNPs in Table A have been genetically mapped relative to the SHELL locus. Table A provides an estimated predictive value for each SNP provided based on the selection of markers mapped. Thus, as an example, SEQ ID NO:1 represents a SNP that is accurate in predicting shell phenotype 83% of the time. Said another way, using the SNP of SEQ ID NO:1 as a genetic marker, one can correctly predict shell phenotype of palm plants 83 out of 100 times. Thus, even at a significant physical distance from the SHELL locus on the palm chromosome, polymorphic markers allow for relatively accurate prediction of shell phenotype of plants. In some embodiments, the polymorphic marker is within 1, 10, 20, 50, 100, 200, 500, 1000 kb from the SHELL gene (e.g., the gene corresponding to SEQ ID NO:8219).

Accordingly, methods of detecting one or more polymorphic marker within a region of the palm genome corresponding to SEQ ID NO:8218 are provided. Such methods are useful for predicting shell phenotype of palm plants for example. While over 8200 specific polymorphisms are provided in Table A, it should be appreciated that the polymorphisms represented in Table A are merely an example of polymorphisms within the genomic region corresponding to SEQ ID NO:8218. Additional polymorphisms can be identified as desired and also be used to predict shell phenotype of a palm plant. Such additional polymorphisms are intended to be encompassed in the methods described herein. Moreover, it will be appreciated that SEQ ID NO:8218 is a representative sequence and that different individual palms may have a corresponding genomic region having one or more nucleotide changes relative to SEQ ID NO:8218 due, for example, to natural variation. As noted elsewhere herein, nevertheless, identifying the region of a genome corresponding to SEQ ID NO:8218 can be readily determined using alignment programs, etc.

The nucleic acid sequences provided herein were generated by nucleotide sequencing and on occasion, include one or more stretches of "N's." These stretches of N's represent gaps in assembly of sequences of an estimated size. The precise number of N's in a sequence is an estimate (for example, 100 N's may only represent 30 bases). N's can be any base, and are likely repetitive sequence in the genome.

Detecting specific polymorphic markers can be accomplished by methods known in the art for detecting sequences at polymorphic sites. For example, standard techniques for genotyping for the presence of SNPs and/or microsatellite markers can be used, such as fluorescence-based techniques (Chen, X. et al., Genome Res. 9(5): 492-98 (1999)), utilizing PCR, LCR, Nested PCR and other techniques for nucleic acid amplification. Specific commercial methodologies available for SNP genotyping include, but are not limited to, TaqMan™ genotyping assays and SNPlex platforms (Applied Biosystems), gel electrophoresis (Applied Biosystems), mass spectrometry (e.g., MassARRAY system from Sequenom), minisequencing methods, real-time PCR, BioPlex system (BioRad), CEQ and SNPstream systems (Beckman), array hybridization technology (e.g., Affymetrix GeneChip; Perlegen), BeadArray Technologies (e.g., Illumina GoldenGate and Infinium assays), array tag technology (e.g., Parallele), and endonuclease-based fluorescence hybridization technology (Invader, Third Wave). Some of the available array platforms, including Affymetrix SNP Array 6.0 and Illumina CNV370-Duo and IM BeadChips, include SNPs that tag certain copy number variants.

In certain embodiments, polymorphic markers are detected by sequencing technologies. Obtaining sequence information about an individual plant identifies particular nucleotides in the context of a sequence. For SNPs, sequence information about a single unique sequence site is sufficient to identify alleles at that particular SNP. For markers comprising more than one nucleotide, sequence information about the nucleotides of the individual that contain the polymorphic site identifies the alleles of the individual for the particular site.

Various methods for obtaining nucleic acid sequence are known to the skilled person, and all such methods are useful for practicing the invention. Sanger sequencing is a well-known method for generating nucleic acid sequence information. Recent methods for obtaining large amounts of sequence data have been developed, and such methods are also contemplated to be useful for obtaining sequence information of a plant, if desired. These include pyrosequencing technology (Ronaghi, M. et al. *Anal Biochem* 267:65-71 (1999); Ronaghi, et al., *Biotechniques* 25:876-878 (1998)), e.g. 454 pyrosequencing (Nyren, P., et al. *Anal Biochem* 208:171-175 (1993)), Illumina/Solexa sequencing technology (http://www.illumina.com; see also Strausberg, R L, et al *Drug Disc Today* 13:569-577 (2008)), and Supported Oligonucleotide Ligation and Detection Platform (SOLiD) technology (Applied Biosystems, http://www.appliedbiosystems.com); Strausberg, R L, et al *Drug Disc Today* 13:569-577 (2008).

Methods of polymorphism detection can be performed on any type of biological sample from the plant that contains nucleic acids (e.g., DNA, RNA). As one particular advantage of the methods is to predict the shell phenotype of young plants before cultivation in the field, in some embodiments, the samples are obtained from a plant that has been germinated less than 1, 2, 4, 6, months or less than 1, 2, 3, 4, or 5 years. In some embodiments, the plants are generated from i) a cross between *dura* and *pisifera* palms ii) the selfing of a *tenera* palm, iii) a cross between two plants having the *tenera* shell phenotype, iv) a cross between *dura* and *tenera* palms, and v) a cross between *tenera* and *pisifera* palms. Because such crosses are not 100% efficient, such crosses result in some percentage of seeds or plants that will not in the future produce seeds or plants with the *tenera* shell phenotype, (in case of i) and the observed number of *tenera* palms observed do not follow the expected Mendellian segregation (ii, iii & iv). By testing seeds or plants resulting from the attempted crosses, one can reduce or eliminate non-*tenera* contaminant seeds or plants from material planted for cultivation (optionally discarding those plants that are predicted to be *dura* and/or *pisifera*). Alternatively, one can identify and segregate plants based on their predicted shell genotype, allowing for selection and cultivation of fields of pure *pisifera* and *dura* trees, if desired, e.g., for later breeding purposes.

III. Transgenic Plants

As discussed above, the SHELL gene of palm has been discovered to control shell phenotype. Thus in some embodiments, plants having modulated expression of a SHELL polypeptide are provided. The more desirable shell phenotype (*tenera*, having a shell less than 2 mm thick) occurs naturally as a heterozygote of the between the *dura* and *pisifera* allele.

It has been discovered that *pisifera* SHELL alleles contain missense mutations in portions of the gene encoding the MADS box domain of the protein, which plays a role in transcription regulation. Thus, it is possible that the *tenera* phenotype results from a reduced level of SHELL protein compared to *dura* plants, which have two copies of the active protein. Accordingly, in some embodiments, plants having reduced level of active SHELL protein compared to a *dura* plant are provided. Such plants can be generated, for example, using gene inhibition technology, including but not limited to siRNA technology, to reduce, but not eliminate, endogenous SHELL gene expression of an active SHELL protein (e.g., in a *dura* or *tenera* background).

Alternatively, a heterologous expression cassette (i.e., a transgene) can be introduced into a *pisifera* background where the expression cassette controls expression of SHELL at a reduced level compared to the native SHELL promoter. This can be achieved, for example, by operably linking a mutated SHELL promoter to a polynucleotide encoding a SHELL polypeptide, thereby weakening the "strength" of the promoter, or by operably linking a heterologous promoter that is weaker than the native SHELL promoter to a polynucleotide encoding a SHELL polypeptide.

Alternatively, it is possible that the *tenera* phenotype results from a mechanism involving the protein:protein interaction of non-DNA binding *pisifera* types of SHELL proteins with fully functional types of SHELL (homodimers) or other MADS-box family members (heterodimers). Thus, in some embodiments, plants that heterologously express a SHELL polypeptide with a functional M, I, and K domain and a non-function C-(MADsbox) domain are provided. M, 1, K, and C domains are described in, e.g., Gramzow and Theissen, 2010 *Genome Biology* 11: 214-224 and the corresponding domains can be identified in the palm sequences described herein. By expressing such a protein having active protein:protein interaction domains but a non-functional DNA binding domain, proteins that interact with the modified SHELL protein will be removed from biological action, thereby resulting in a reduced shell thickness. Thus, for example, one can express either of the *pisifera* alleles described herein under control of a heterologous promoter in the plant (e.g., a palm plant, e.g., a *dura* background), thereby resulting in the reduced shell thickness.

A. Inhibition or Suppression of Gene Expression

The invention provides methods for controlling shell trait in a palm (e.g., oil palm, coconut, or date palm) or other plant by reducing expression of an endogenous nucleic acid molecule encoding a SHELL polypeptide. For example, in a transgenic plant, a nucleic acid molecule, or antisense, siRNA, microRNA, or dsRNA constructs thereof, targeting a SHELL gene product, or fragment thereof, or a SHELL mRNA, or fragment thereof can be operatively linked to an exogenous regulatory element, wherein expression of the construct suppresses endogenous SHELL expression.

A number of methods can be used to inhibit gene expression in plants. For instance, antisense technology can be conveniently used. To accomplish this, a nucleic acid segment from the desired gene is cloned and operably linked to a promoter such that the antisense strand of RNA will be transcribed. The expression cassette is then transformed into plants and the antisense strand of RNA is produced. In plant cells, it has been suggested that antisense RNA inhibits gene expression by preventing the accumulation of mRNA which encodes the protein of interest, see, e.g., Sheehy et al., *Proc. Nat. Acad. Sci. USA*, 85:8805-8809 (1988); Pnueli et al., *The Plant Cell* 6:175-186 (1994); and Hiatt et al., U.S. Pat. No. 4,801,340.

The antisense nucleic acid sequence transformed into plants will be substantially identical to at least a portion of the endogenous gene or genes to be repressed. The sequence, however, does not have to be perfectly identical to inhibit expression. Thus, an antisense or sense nucleic acid molecule encoding only a portion of a SHELL-encoding sequence can be useful for producing a plant in which SHELL expression is suppressed. The vectors of the present invention can be designed such that the inhibitory effect applies to other proteins within a family of genes exhibiting homology or substantial homology to the target gene, or alternatively such that other family members are not substantially inhibited.

For antisense suppression, the introduced sequence also need not be full length relative to either the primary transcription product or fully processed mRNA. Generally, higher homology can be used to compensate for the use of a shorter sequence. Furthermore, the introduced sequence need not have the same intron or exon pattern, and homology of non-coding segments may be equally effective. In some embodiments, a sequence of at least, e.g., 15, 20, 25 30, 50, 100, 200, or more continuous nucleotides (up to mRNA full length) substantially identical to an endogenous SHELL mRNA, or a complement thereof, can be used.

Catalytic RNA molecules or ribozymes can also be used to inhibit expression of SHELL genes. It is possible to design ribozymes that specifically pair with virtually any target RNA and cleave the phosphodiester backbone at a specific location, thereby functionally inactivating the target RNA. In carrying out this cleavage, the ribozyme is not itself altered, and is thus capable of recycling and cleaving other molecules, making it a true enzyme. The inclusion of ribozyme sequences within antisense RNAs confers RNA-cleaving activity upon them, thereby increasing the activity of the constructs.

A number of classes of ribozymes have been identified. One class of ribozymes is derived from a number of small circular RNAs that are capable of self-cleavage and replication in plants. The RNAs replicate either alone (viroid RNAs) or with a helper virus (satellite RNAs). Examples include RNAs from avocado sunblotch viroid and the satellite RNAs from tobacco ringspot virus, lucerne transient streak virus, velvet tobacco mottle virus, *Solanum nodiforum* mottle virus and subterranean clover mottle virus. The design and use of target RNA-specific ribozymes is described in Haseloff et al. *Nature*, 334:585-591 (1988).

Another method of suppression is sense suppression (also known as co-suppression). Introduction of expression cassettes in which a nucleic acid is configured in the sense orientation with respect to the promoter has been shown to be an effective means by which to block the transcription of target genes. For an example of the use of this method to modulate expression of endogenous genes see, Napoli et al., *The Plant Cell* 2:279-289 (1990); Flavell, *Proc. Natl. Acad. Sci., USA* 91:3490-3496 (1994); Kooter and Mol, *Current Opin. Biol.* 4:166-171 (1993); and U.S. Pat. Nos. 5,034,323, 5,231,020, and 5,283,184.

Generally, where inhibition of expression is desired, some transcription of the introduced sequence occurs. The effect may occur where the introduced sequence contains no coding sequence per se, but only intron or untranslated sequences homologous to sequences present in the primary transcript of the endogenous sequence. The introduced sequence generally will be substantially identical to the endogenous sequence intended to be repressed. This minimal identity will typically be greater than about 65%, but a higher identity might exert a more effective repression of expression of the endogenous sequences. In some embodiments, the level of identity is more than about 80% or about 95%. As with antisense regulation, the effect can apply to any other proteins within a similar family of genes exhibiting homology or substantial homology and thus which area of the endogenous gene is targeted will depend whether one wished to inhibit, or avoid inhibition, of other gene family members.

For sense suppression, the introduced sequence in the expression cassette, needing less than absolute identity, also need not be full length, relative to either the primary transcription product or fully processed mRNA. This may be preferred to avoid concurrent production of some plants that are overexpressers. A higher identity in a shorter than full length sequence compensates for a longer, less identical sequence. Furthermore, the introduced sequence need not have the same intron or exon pattern, and identity of non-coding segments will be equally effective. Normally, a sequence of the size ranges noted above for antisense regulation is used.

Endogenous gene expression may also be suppressed by way of RNA interference (RNAi), which uses a double-stranded RNA having a sequence identical or similar to the sequence of the target gene. RNAi is the phenomenon in which when a double-stranded RNA having a sequence identical or similar to that of the target gene is introduced into a cell, the expressions of both the inserted exogenous gene and target endogenous gene are suppressed. The double-stranded RNA may be formed from two separate complementary RNAs or may be a single RNA with internally complementary sequences that form a double-stranded RNA. Although details of the mechanism of RNAi are still unknown, it is considered that the introduced double-stranded RNA is initially cleaved into small fragments, which then serve as indexes of the target gene in some manner, thereby degrading the target gene. RNAi is known to be also effective in plants (see, e.g., Chuang, C. F. & Meyerowitz, E. M., *Proc. Natl. Acad. Sci. USA* 97: 4985 (2000); Waterhouse et al., *Proc. Natl. Acad. Sci. USA* 95:13959-13964 (1998); Tabara et al. *Science* 282:430-431 (1998)). For example, to achieve suppression of the expression of a DNA encoding a protein using RNAi, a double-stranded RNA having the sequence of a DNA encoding the protein, or a substantially similar sequence thereof (including those engineered not to translate the protein) or fragment thereof, is introduced into a plant of interest. The resulting plants may then be screened for a phenotype associated with the target protein and/or by monitoring steady-state RNA levels for transcripts encoding the protein. Although the genes used for RNAi need not be completely identical to the target gene, they may be at least 70%, 80%. 90%, 95% or more identical to the target gene sequence. See, e.g., U.S.

Patent Publication No. 2004/0029283. The constructs encoding an RNA molecule with a stem-loop structure that is unrelated to the target gene and that is positioned distally to a sequence specific for the gene of interest may also be used to inhibit target gene expression. See, e.g., U.S. Patent Publication No. 2003/0221211.

The RNAi polynucleotides may encompass the full-length target RNA or may correspond to a fragment of the target RNA. In some cases, the fragment will have fewer than 100, 200, 300, 400, 500 600, 700, 800, 900 or 1,000 nucleotides corresponding to the target sequence. In addition, in some embodiments, these fragments are at least, e.g., 50, 100, 150, 200, or more nucleotides in length. In some cases, fragments for use in RNAi will be at least substantially similar to regions of a target protein that do not occur in other proteins in the organism or may be selected to have as little similarity to other organism transcripts as possible, e.g., selected by comparison to sequences in analyzing publicly-available sequence databases.

Expression vectors that continually express siRNA in transiently- and stably-transfected have been engineered to express small hairpin RNAs, which get processed in vivo into siRNAs molecules capable of carrying out gene-specific silencing (Brummelkamp et al., *Science* 296:550-553 (2002), and Paddison, et al., *Genes & Dev.* 16:948-958 (2002)). Post-transcriptional gene silencing by double-stranded RNA is discussed in further detail by Hammond et al. *Nature Rev Gen* 2: 110-119 (2001), Fire et al. *Nature* 391: 806-811 (1998) and Timmons and Fire *Nature* 395: 854 (1998).

One of skill in the art will recognize that using technology based on specific nucleotide sequences (e.g., antisense or sense suppression, siRNA, microRNA technology, etc.), families of homologous genes can be suppressed with a single sense or antisense transcript. For instance, if a sense or antisense transcript is designed to have a sequence that is conserved among a family of genes, then multiple members of a gene family can be suppressed. Conversely, if the goal is to only suppress one member of a homologous gene family, then the sense or antisense transcript should be targeted to sequences with the most variance between family members.

Yet another way to suppress expression of an endogenous plant gene is by recombinant expression of a microRNA that suppresses a target (e.g., a SHELL gene). Artificial microRNAs are single-stranded RNAs (e.g., between 18-25 mers, generally 21 mers), that are not normally found in plants and that are processed from endogenous miRNA precursors. Their sequences are designed according to the determinants of plant miRNA target selection, such that the artificial microRNA specifically silences its intended target gene(s) and are generally described in Schwab et al, *The Plant Cell* 18:1121-1133 (2006) as well as the internet-based methods of designing such microRNAs as described therein. See also, US Patent Publication No. 2008/0313773.

B. Use of Nucleic Acids of the Invention to Enhance Gene Expression

Nucleic acid sequences encoding all or an active part of a SHELL polypeptide (including but not limited to polypeptides substantially identical to SEQ ID NO:8220, 8221, or 8222, or SHELL polypeptides having a functional M, 1, and K domain and a non-function C, which when expressed control shell thickness) can be used to prepare expression cassettes that enhance, or increase SHELL gene expression. Where overexpression of a gene is desired, the desired SHELL gene from a different species may be used to decrease potential sense suppression effects.

Any of a number of means well known in the art can be used to increase SHELL activity in plants. Any organ can be targeted, such as shoot vegetative organs/structures (e.g. leaves, stems and tubers), roots, flowers and floral organs/structures (e.g. bracts, sepals, petals, stamens, carpels, anthers and ovules), seed (including embryo, endosperm, and seed coat) and fruit. Alternatively, a SHELL gene can be expressed constitutively (e.g., using the CaMV 35S promoter).

One of skill will recognize that the polypeptides encoded by the genes of the invention, like other proteins, have different domains which perform different functions. Thus, the gene sequences need not be full length, so long as the desired functional domain of the protein is expressed.

III. Preparation of Recombinant Vectors

In some embodiments, to use isolated sequences in the above techniques, recombinant DNA vectors suitable for transformation of plant cells are prepared. Techniques for transforming a wide variety of higher plant species are well known and described in the technical and scientific literature. See, for example, Weising et al. *Ann. Rev. Genet.* 22:421-477 (1988). A DNA sequence coding for the desired polypeptide, for example a cDNA sequence encoding a full length protein, will preferably be combined with transcriptional and translational initiation regulatory sequences which will direct the transcription of the sequence from the gene in the intended tissues of the transformed plant.

For example, for overexpression, a plant promoter fragment may be employed which will direct expression of the gene in all tissues of a regenerated plant. Such promoters are referred to herein as "constitutive" promoters and are active under most environmental conditions and states of development or cell differentiation. Examples of constitutive promoters include the cauliflower mosaic virus (CaMV) 35S transcription initiation region, the 1'- or 2'-promoter derived from T-DNA of *Agrobacterium tumefaciens*, and other transcription initiation regions from various plant genes known to those of skill.

Alternatively, the plant promoter may direct expression of the polynucleotide of the invention in a specific tissue (tissue-specific promoters) or may be otherwise under more precise environmental control (inducible promoters). Examples of tissue-specific promoters under developmental control include promoters that initiate transcription only in certain tissues, such as fruit, seeds, or flowers. Examples of environmental conditions that may affect transcription by inducible promoters include anaerobic conditions, elevated temperature, or the presence of light.

If proper polypeptide expression is desired, a polyadenylation region at the 3'-end of the coding region should be included. The polyadenylation region can be derived from the natural gene, from a variety of other plant genes, or from T-DNA.

The vector comprising the sequences (e.g., promoters or coding regions) from genes of the invention can optionally comprise a marker gene that confers a selectable phenotype on plant cells. For example, the marker may encode biocide resistance, particularly antibiotic resistance, such as resistance to kanamycin, G418, bleomycin, hygromycin, or herbicide resistance, such as resistance to chlorosluforon or Basta.

SHELL nucleic acid operably linked to a promoter is provided that, in some embodiments, is capable of driving the transcription of the SHELL coding sequence in plants. The promoter can be, e.g., derived from plant or viral sources. The promoter can be, e.g., constitutively active, inducible, or tissue specific. In construction of recombinant expression cassettes, vectors, transgenics, of the invention, a different promoters can be chosen and employed to differentially direct gene expression, e.g., in some or all tissues of a plant or animal. In some embodiments, as discussed above, desired promoters are identified by analyzing the 5' sequences of a genomic clone corresponding to a SHELL gene as described here.

V. Production of Transgenic Plants

DNA constructs of the invention may be introduced into the genome of the desired plant host by a variety of conventional techniques. For example, the DNA construct may be introduced directly into the genomic DNA of the plant cell using techniques such as electroporation and microinjection of plant cell protoplasts, or the DNA constructs can be introduced directly to plant tissue using ballistic methods, such as DNA particle bombardment. Alternatively, the DNA constructs may be combined with suitable T-DNA flanking regions and introduced into a conventional *Agrobacterium tumefaciens* host vector. The virulence functions of the *Agrobacterium tumefaciens* host will direct the insertion of the construct and adjacent marker into the plant cell DNA when the cell is infected by the bacteria.

Various palm transformation methods have been described. See, e.g., Masani and Parveez, *Electronic Journal of Biotechnology* Vol. 11 No. 3, Jul. 15, 2008; Chowdury et al., *Plant Cell Reports*, Volume 16, Number 5, 277-281 (1997).

Microinjection techniques are known in the art and well described in the scientific and patent literature. The introduction of DNA constructs using polyethylene glycol precipitation is described in Paszkowski et al. *EMBO J.* 3:2717-2722 (1984). Electroporation techniques are described in Fromm et al. *Proc. Natl. Acad. Sci. USA* 82:5824 (1985). Ballistic transformation techniques are described in Klein et al. *Nature* 327:70-73 (1987).

*Agrobacterium tumefaciens*-mediated transformation techniques, including disarming and use of binary vectors, are well described in the scientific literature. See, for example Horsch et al. *Science* 233:496-498 (1984), and Fraley et al. *Proc. Natl. Acad. Sci. USA* 80:4803 (1983).

Transformed plant cells that are derived from any transformation technique can be cultured to regenerate a whole plant that possesses the transformed genotype and thus the desired phenotype. Such regeneration techniques rely on manipulation of certain phytohormones in a tissue culture growth medium, optionally relying on a biocide and/or herbicide marker that has been introduced together with the desired nucleotide sequences. Plant regeneration from cultured protoplasts is described in Evans et al., Protoplasts Isolation and Culture, Handbook of Plant Cell Culture, pp. 124-176, MacMillilan Publishing Company, New York, 1983; and Binding, Regeneration of Plants, Plant Protoplasts, pp. 21-73, CRC Press, Boca Raton, 1985. Regeneration can also be obtained from plant callus, explants, organs, or parts thereof. Such regeneration techniques are described generally in Klee et al. *Ann. Rev. of Plant Phys.* 38:467-486 (1987).

The nucleic acids of the invention can be used to confer desired traits on essentially any plant. Thus, the invention has use over a broad range of plants, including species from the genera *Asparagus, Atropa, Avena, Brassica, Citrus, Citrullus, Capsicum, Cucumis, Cucurbita, Daucus, Fragaria, Glcine, Gossypium, Helianthus, Heterocallis, Hordeum, Hyoscyamus, Lactuca, Linum, Lolium, Lycopersicon, Malus, Manihot, Majorana, Medicago, Nicotiana, Oryza, Panieum, Pannesetum, Persea, Pisum, Pyrus, Prunus, Raphanus, Secale, Senecio, Sinapis, Solaum, Sorghum, Trigonella, Triticum, Vitis, Vigna, and, Zea*. Plants having a shell, and thus those that have use in the present invention, include but are not limited to dicotyledons and monocotyledons including but not limited to palm.

EXAMPLES

The following examples are offered to illustrate, but not to limit the claimed invention.

i. Example 1

Plant Materials, DNA Extraction and Restriction Enzyme Digestion

The mapping family used for generating the genetic linkage map was derived from the selfing of the high iodine value (IV) *tenera* palm, T128, from MPOB's Nigerian germplasm collection (Rajanaidu, 1990). Controlled self-pollination was used to generate the mapping family. A total of 241 palms were originally planted at several locations in Malaysia, including the MPOB-UKM Research Station at Bangi, Selangor, Ulu Paka Research Station at Terengganu, Keratong Research Station at Pahang, Lahad Datu Research Station at Sabah, United Plantations, Teluk Intan, Perak and FELDA Research Station at Jerantut, Pahang. Of the 241 palms, 240 were still available for both marker and phenotype analysis.

Unopened leaf samples (spear leaf) were collected from individual palms and immediately frozen under liquid nitrogen and then stored at −80° C. until DNA preparation. DNA from the leaf samples was extracted and purified using the method described by Doyle and Doyle (1990).

Standard RFLP analysis was performed as described by Singh et al., 2009. The RFLP probes used in this study were complementary DNA (cDNA) clones obtained from various cDNA libraries (young etiolated seedling, mesocarp, kernel and root) constructed previously as described by Cheah et al. (1996). cDNA clones from a subtracted flower library (Cheah and Rajinder, 1998) were also used to screen the mapping population.

The cDNA clones were picked at random from the various libraries. Plasmid DNA was prepared from individual clones by using column purification, with Qiagen-tip 20 (Qiagen) as described by the manufacturer. The concentration of the prepared plasmids was determined by using ethidium bromide plates (Sambrook et al. 1989).

The presence of DNA insert was examined by restriction digestion of 1 ug plasmid DNA with 10 U of the appropriate restriction enzyme for 3 hours, to release the insert DNA. One fifth (⅕) volume of loading buffer, FOG, was added to the digestion mix and the fragments were separated by electrophoresis through a 1.5% agarose gel. cDNA clones with insert size larger than 500 base-pairs (bp) were selected to screen for their ability to detect RFLP in the mapping population.

Probes for mapping were derived from the selected plasmids as polymerase chain reaction (PCR) amplified DNA fragments. Bacterial clones containing selected probes were maintained as frozen glycerol stocks at −80° C.

The DNA probes were labeled for RFLP analysis as described by Singh et al., 2009.

ii. Example 2

Simple Sequence Repeat (SSR) Analysis and SNP Analysis

SSR analysis was carried out essentially as described by Singh et al., 2009. The SSR primers were sourced as follows: i) A SSR enriched library described by Singh et al., 2007, ii) the published microsatellite primer pairs (Billotte et al., 2005) were also tested on the mapping populations, and iii) SSR primers derived from MPOB's in-house expressed sequence tag (EST) collection and genomic sequences were also used in map construction.

The OPSNP3 SNP set comprising 4,451 SNPs was interrogated using the Illumina iSelect Infinium 11 assay. The automatic allele calling for each SNP locus was accomplished with the GenCall software (Illumina San Diego, Calif.). The Genome Studio software (version 2010.3) was used to analyze the SNP genotyping data.

The individual RFLP, SSR and SNP loci were scored as co-dominant markers and, for this selfed cross, loci segregating in the 1:2:1 ratios were scored. Some RFLP probes and SSR primers revealed complex patterns, for which the alleles were difficult to determine. For such cases, segregating bands were individually scored as being absent or present.

Table 2 below illustrates the 2 different types of segregation patterns observed in the mapping family from RFLP, SSR, SNP and AFLP markers.

iii.

TABLE 2 iii. Illustration of the two different types of segregation patterns observed in the mapping family from RFLP, SSR, SNP and AFLP markers.

| | Parent phenotype | Progeny phenotype | Phenotype ratio in the progeny |
|---|---|---|---|
| Loci defined by a single band | | | 3:1 |
| Loci defined by allelic bands | 2 alleles | | 1:2:1 |

Example 3

Determining and Evaluating Fruit Form in the Mapping Family

In the present study, the identification of the shell gene was of interest. The monogenic trait scored was the fruit form. The trait was evaluated on ripened bunches in the field. All 240 F1 progeny, derived by controlled self-pollination of the Nigerian *tenera* accession T128 and grown over two decades in plantations throughout Malaysia, were scored for fruit form phenotype (Rajanaidu et al., 1989). Oil palm trees were grown to maturity in open plantations, making accurate phenotyping of fruit form for some samples difficult due to variation in fertility, yield and environment. Several fruits were harvested from each palm, and shell thickness and fruit form was determined using established criteria.

In order to determine the fruit form, the individual fruits were cut into two equal halves using a sharp knife. A visual observation was made of the shell and classified according to Corley & Tinker, 2003 and Hartley 1988, as follows:

*dura*: thick shelled (2-8 mm), with no fibre ring

*tenera*: thin shelled (0.5-3 mm), with a fibre ring surrounding the shell

*pisifera*: shell-less

In most cases, the presence of the fibre ring was sufficient to distinguish between *dura* and *tenera* fruit forms. An experienced oil palm breeder assisted with the evaluation of the traits.

To assess the accuracy of the fruit form phenotypic data used in the study, we reviewed 460 phenotype calls which were made between 2003 and 2012. In this period, up to three independent attempts were made to visually determine the fruit form phenotypes of 339 palms, 240 of which were from the T-128 selfed population used to map SHELL, and 99 from a different population for which re-phenotyping data were available. In the data, ambiguous calls were made 26 times (or 5.7% of total phenotype determinations) where breeders were unsure of the fruit form phenotype.

The segregation data for the phenotypic characters observed in the mapping family is listed in Table 3.

iv.

TABLE 3 iv. Analysis of palms for fruit form

| | | Fruit Type | | | | | | |
|---|---|---|---|---|---|---|---|---|
| Number of palms | Expected Ratio | | | Observed Number | | | | |
| genotyped[#] | Dura | Tenera | Pisifera | Dura | Tenera | Pisifera | Total[#] | $\chi^2$ |
| 240 | 1 | 2 | 1 | 68 | 124 | 46 | 238 | 1.63 |

[#]There was a discrepancy between the total number of palms genotyped and that observed for fruit type because two palms could not be phenotyped accurately..

The shell gene trait in the mapping family used in this study met the expected Mendelian ratio (1:2:1 for the *dura, tenera* and *pisifera* fruit forms, respectively). The other three reports to date on mapping of the shell gene locus (Mayes et al., 1997; Moretszohn et al., 2000 and Bilotte et al., 2005) did not indicate if the trait met the expected Mendelian ratio in the mapping families employed in their study.

v. Example 4

Map Construction and Evaluation of Monogenic Traits

In constructing the genetic map, apart from the 200 RFLP and SSR markers, the progeny consisting of 240 palms were genotyped for 4,451 SNP markers derived from the oil palm genome sequence by the Infinium iSelect® Assay (Illumina). Map construction for the 240 available progeny palms obtained from self-pollination of the Nigerian *tenera* palm T128 was carried out by using the Joinmap ver. 4.0 computer programme (Ooijen, 2006). The oil palm is an out-breeding species, and as such, a high degree of heterozygosity can be expected in its genome. The progeny palms from the selfed cross can thus be expected to behave like an $F_2$ population.

However, in map construction, it is useful to first determine the "phases" of the markers, either in coupling or repulsion. For this reason, two sets of the genotype data were then created, whereby one set is the converse of the other to account for phase differences in the T128 selfed F2 population. Markers that exhibited severe distortion (p<0.0001) and markers having more than 10% missing data were excluded. Both sets of genotype data were then grouped at a recombination frequency of ≤0.2. Eighteen nodes were selected to create 18 initial groups for calculating the linkage groups.

The linkages were calculated and loci ordered based on the maximum likelihood algorithm. None of the markers showed severe distortion (p<0.0001). The few distorted markers observed were significant at p<0.05-0.1. These markers were removed from further analysis when necessary. Markers exhibiting nearest neighbour stress (N.N, Stress) value >2 (cM) were identified and excluded from the analysis. Markers contributing to insufficient linkages were also determined and removed. The T128 co-dominant map constructed consisted of 16 groups. The number of linkage groups observed matched the haploid chromosome number of oil palm (Maria et al. 1995).

Figure 1:
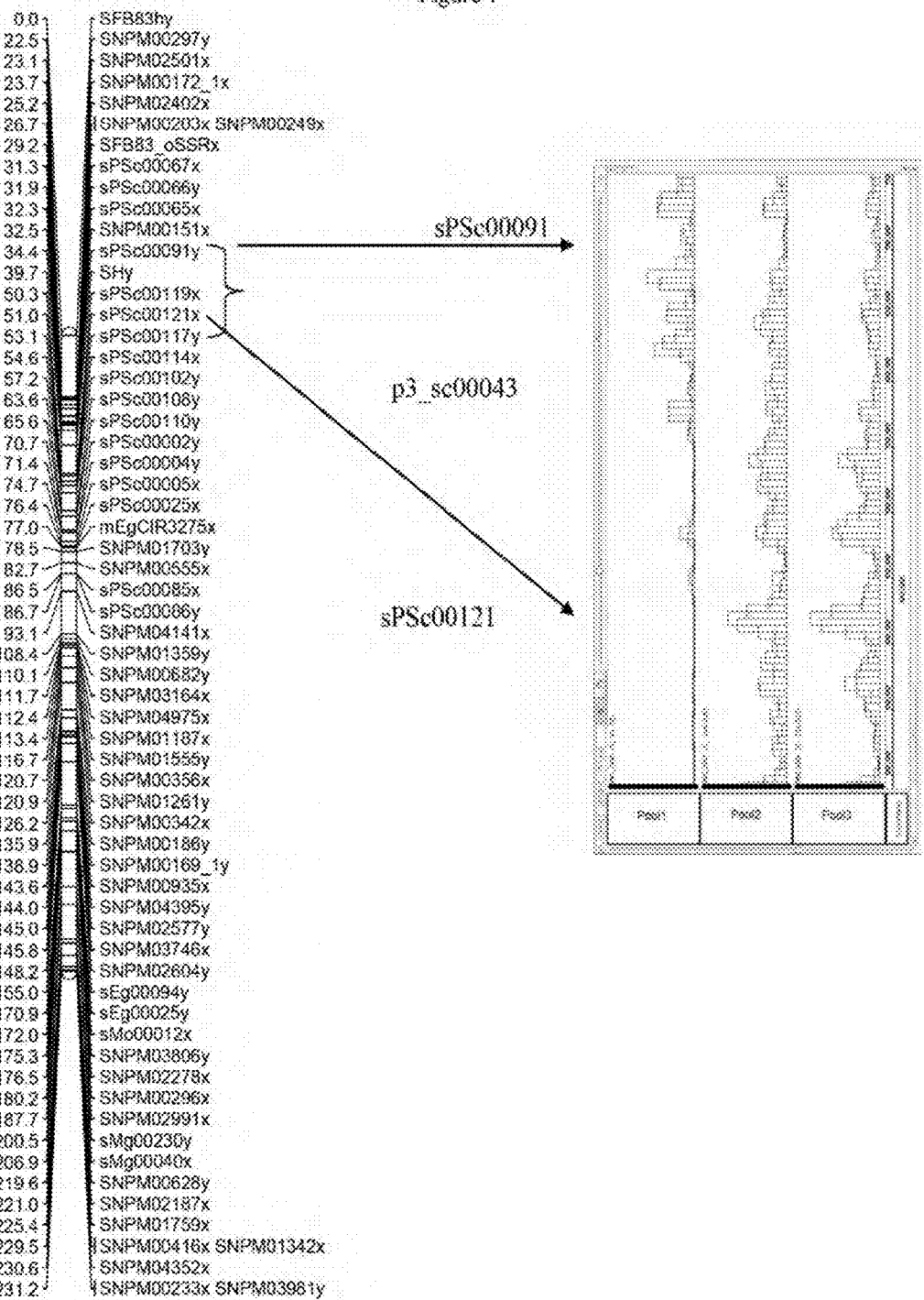
FIG. 1. Genomic scaffolds corresponding to linkage group 7 and resulting homozygosity profile. Based on genetic mapping, the Shell gene (Sh) was placed at 39.7 cM on linkage group 7. Once markers from this region were compared to the reference genomic sequence for *Pisifera*, the gene was localized to scaffold 43 (SEQ ID NO:8218). SNP frequency was greatly reduced in this region for AVROS palms with *Pisifera* fruit type (pool1) as compared to Nigerian palms with *Pisifera* fruit (pool2), and to *Dura* and *Tenera* palms (pool3). Because it is known that in the AVROS line the *Pisifera* trait came from a single progenitor, this homozygous region is indicative of carrying the Shell gene.

After construction of the consensus map, shell was placed on linkage group 7 (FIG. 1) and comparison of the linkage group to that published by Billotte et al., (2005) indicated shell was located within the expected region. More importantly the shell gene was flanked by two SSR markers, sPSc00119 (about 10 cM) on one side, and sPSc00091 (about 5 cM) on the other side.

The SHELL gene had been previously mapped 4.7 cM and 9.8 cM away from the closest molecular marker (Billotte et al., 2005; Mayes et al., 1997; Moretzsohn et al. 2000) but has proven extremely challenging to identify given the large genome, long generation times and difficulty of phenotyping in experimental populations of oil palm, which are widely distributed among different plantations. To help with identification of the shell gene, great care was taken to phenotype the monogenic trait carefully as described above. Subsequently we took advantage of the oil palm genome sequence to identify the shell gene.

Example 5

Whole Genome Sequencing and Assembly, Comparison of Linkage Group with Genome Scaffolds, Homozygosity Mapping and the Evaluation of Candidate Genes An AVROS *Pisifera* palm was sequenced to high coverage on the 454 XL next generation sequencing platform (454/Roche). Sequence reads were generated from DNA fragment libraries and from a complex series of linker libraries (or jumping libraries) where read ends span fragment sizes ranging from 0.75 kb to >30 kb. Sequence reads were assembled with the Newbler assembler (Roche 454, Bradford, Conn.) producing a reference sequence of the oil palm genome. Scaffolds from the reference assembly containing markers genetically mapped in the shell interval were identified. A BAC physical map was constructed from a 10 fold BAC library constructed from the same AVROS *Pisifera* used to generate the reference sequence. BAC end sequences were also generated from each BAC in the library using standard Sanger sequencing on the 3730 sequencing platform (Life Technologies). BAC end sequences were assembled into the reference genome with the Newbler assembler. A minimum tiling path of BAC clones spanning the SHELL interval was selected, and BAC clones in the tiling path were sequenced in pools to high coverage with 454 XL technology. The reference genome was reassembled including the original 454 whole genome shotgun sequence data, the BAC pool sequence data and all BAC end sequences. Improved scaffold coverage and scaffold length spanning the shell interval was produced. Two pedigrees were used in homozygosity mapping studies. A total of 43 individual AVROS *pisifera* palms (originating from Zaire, Africa) were the first pedigree used. Additionally, a total of 14 of the AVROS *Pisifera* palms were independently sequenced while the DNA from the remaining 29 palms were pooled together for deep sequencing (Pool 1). The second pedigree was the progeny palms from the selfing of the Nigerian *tenera* palm T128. The DNA of thirty (30) *pisifera* palms from the Nigerian selfed palm were also pooled and sequenced (Pool 2). In Pool 3, DNA from 17 Nigerian *dura* palms and 20 Nigerian *tenera* palms were pooled and sequenced. Whole genome shotgun sequence data was generated on the HISEQ 2000 (Illumina). Individual trees and pools of trees were sequenced to 20 and 40 fold raw sequence coverage respectively. Individual reads from each tree and from each pool were read mapped to sequence scaffolds form the reference genome assembly described above.

The SNP markers on linkage group 7 were subsequently mapped by sequence similarity to a 3.4 Mb assembly Scaffold 43 (p3-sc00043). The scaffolds corresponding to linkage group 7 containing the SHELL gene is presented in FIG. 1. The order of the markers on the linkage group corresponded to the physical order of the markers on the scaffolds, providing confidence on the genetic map constructed. We predicted that the shell gene is most likely contained in Scaffold 43 (p3_sc00043), the scaffold containing the highest probability interval. A tiling path of BAC contigs corresponding to Scaffold 43 was selected from a high-information content physical map of *pisifera* and sequenced. Additional 50 SNP assays were designed from an improved assembly corresponding to Scaffold 43.

Thirty additional SNP markers were also designed from the scaffolds p3-sc00191, p3-sc00203 and p3-sc02216, which were also associated with linkage Group 7. These 80

SNP markers (designated as SNPE) were also genotyped on the 240 palms from the Nigerian T128 selfed population using the Sequenom MassArray® iPlex platform. Of the 80 SNPE SNP markers tested, 63 (78%) were polymorphic. The additional 63 SNP genotypes were incorporated into the map as above giving a final co-dominant genetic linkage map consisting of 828 markers [722 SNP (inclusive of SNPE), 103 SSR, 2 RFLP markers and shell in 16 linkage groups (FIG. 2).

Shell remained in linkage group 7 (FIG. 2), together with the 63 SNPE markers developed from the selected scaffolds. The final size of linkage group 7 is 172.2 cM with an average of 1.2 cM between two adjacent markers.

Figure 2:
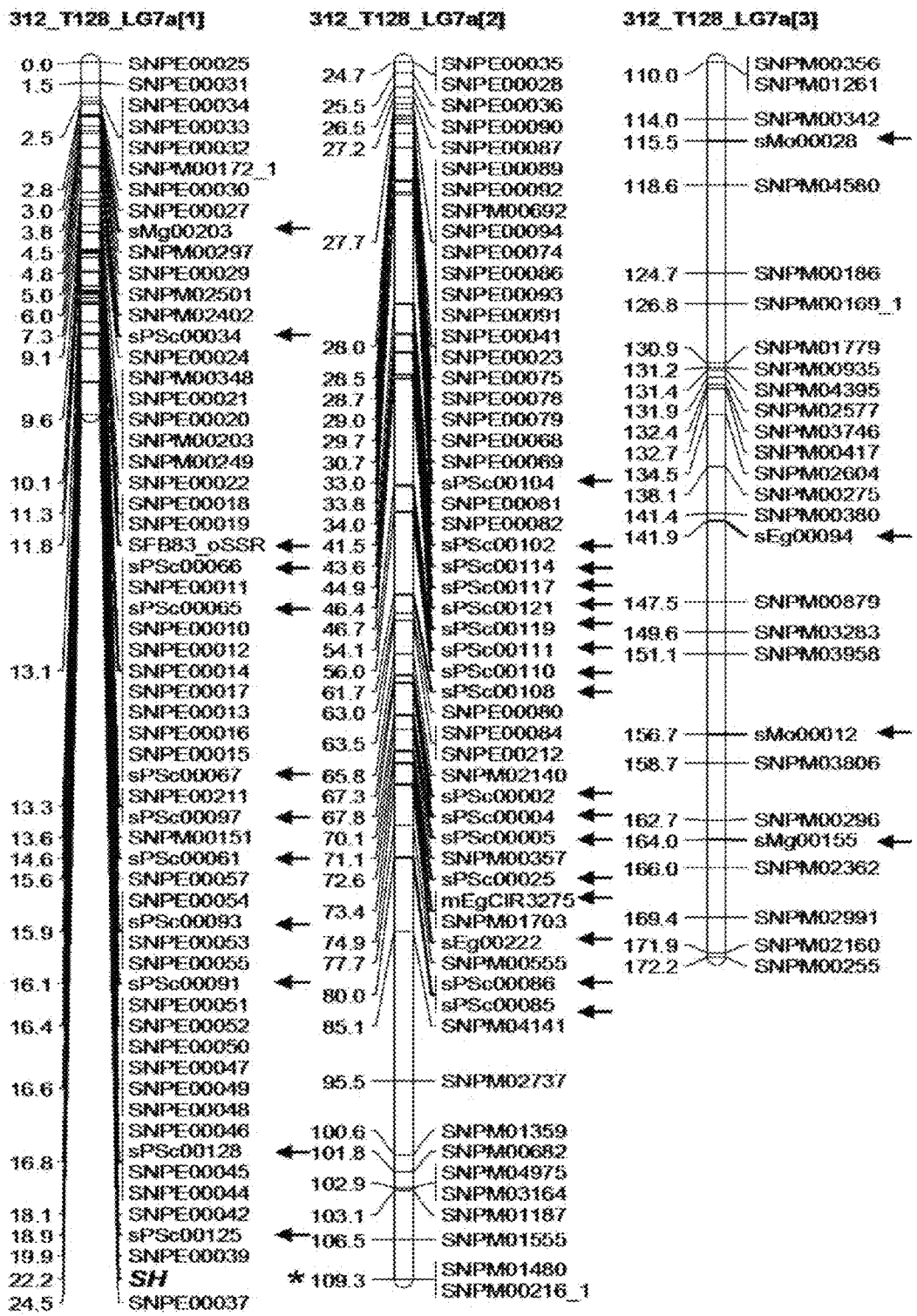
FIG. 2. Linkage Group 7 containing SHELL. A map of the SHELL chromosome (Linkage Group 7) derived from the T128 population. Arrows denote the SSR markers. The SHELL gene is marked by (SH and an asterisk). All other markers are SNP markers.

The shell gene locus was successfully mapped in Group 7, this time flanked by two SNP markers, namely SNPE00039, SNPE00037 (about 3 cM) on either side (FIG. 2). Table 4 shows that the predictability of the markers for the trait in the mapping family was about 95% for both markers. In a review of single marker data, recombinant breakpoints were identified indicating the gene lay in a 450 kb interval in Scaffold 43.

TABLE 4

Linkage of SNP markers to the shell gene locus in the mapping family

| Marker | No. of palms with genotype & phenotype | No. palms matching expected profile | No. of recombinants | Position in Linkage Group 7 | % predict-ability |
|---|---|---|---|---|---|
| SNPE00047 | 234 | 217 | 17 | 16.60 | 92.74 |
| SNPE00048 | 234 | 217 | 17 | 16.60 | 92.74 |
| SNPE00049 | 234 | 217 | 17 | 16.60 | 92.74 |
| SNPE00044 | 235 | 219 | 16 | 16.85 | 93.19 |
| SNPE00046 | 235 | 219 | 16 | 16.85 | 93.19 |
| SNPE00045 | 234 | 218 | 16 | 16.85 | 93.16 |
| sPSc00128 | 234 | 217 | 17 | 16.85 | 92.74 |
| SNPE00042 | 234 | 222 | 12 | 18.11 | 94.87 |
| sPSc00125 | 233 | 216 | 17 | 18.86 | 92.70 |
| SNPE00039 | 235 | 224 | 11 | 19.87 | 95.32 |
| Shell Locus | | | | | |
| SNPE00037 | 235 | 224 | 11 | 24.46 | 95.32 |
| SNPE00035 | 235 | 224 | 11 | 24.71 | 95.32 |
| SNPE00028 | 235 | 223 | 12 | 24.71 | 94.89 |
| SNPE00036 | 233 | 220 | 13 | 25.46 | 94.42 |
| SNPE00090 | 233 | 216 | 17 | 26.47 | 92.70 |
| SNPE00087 | 233 | 216 | 17 | 27.22 | 92.70 |

Figure 3:
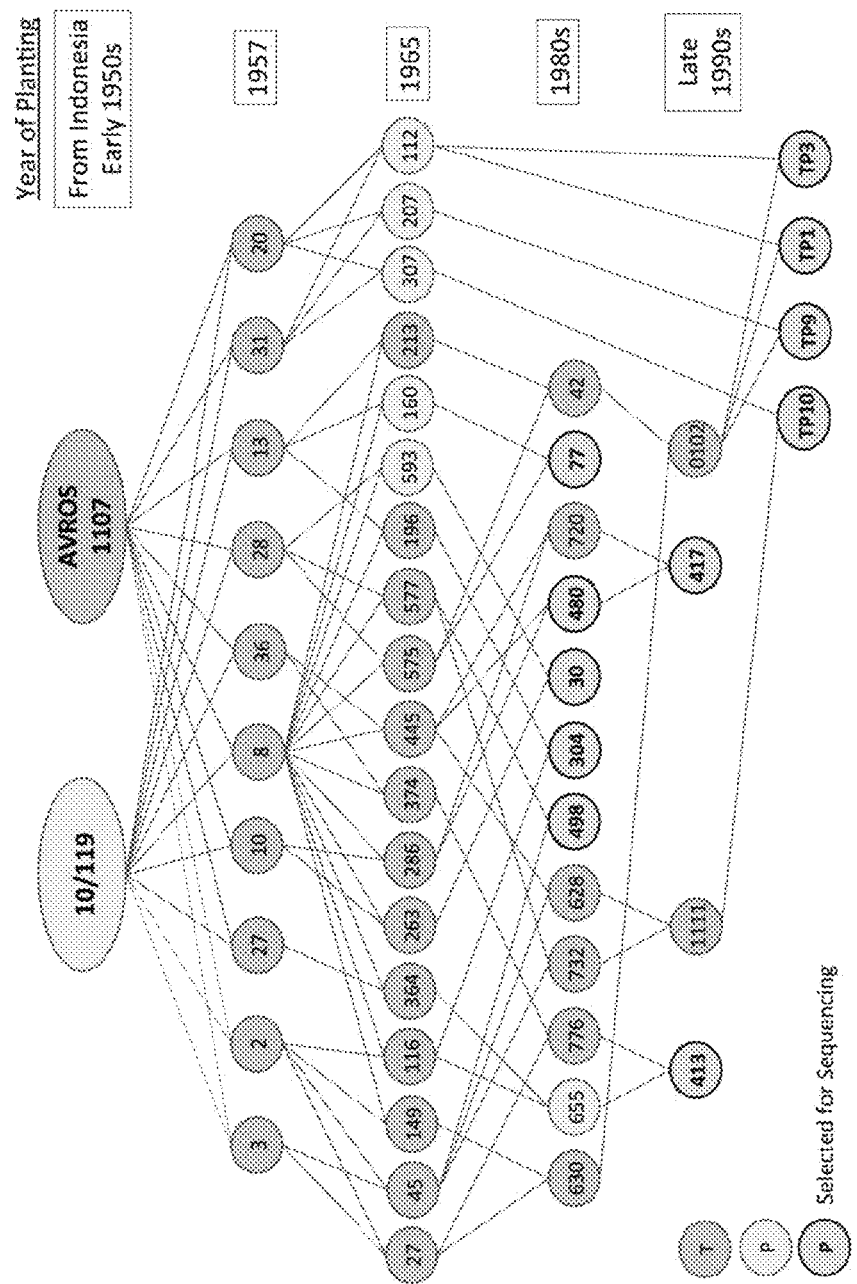
FIG. 3. The AVROS pedigree for homozygosity mapping. Palms heterozygous (*tenera:* 1107, 3, 2, 27, 10, 8, 36, 28, 13, 31, 20, 27, 45, 149, 116, 364, 263, 286, 374, 445, 575, 577, 196, 213, 630, 776, 732, 628, 720, 42, 1111, 0102) and homozygous (*pisifera:* 10/119, 593, 160, 307, 207, 112, 655, 498, 304, 30, 480, 77, 413, 417, TP10, TP9, TP1, TP3) for the SHELL gene are indicated, linked to parents and progeny planted over 5 decades. Eleven of the individually sequenced palms are: 498, 304, 30, 480, 77, 413, 417, TP10, TP9, TP1, TP3. Three additional *pisifera* palms from this extended pedigree were also individually sequenced (not shown) while the remaining *pisifera* palms were sequenced as a pool.
Figure 4:
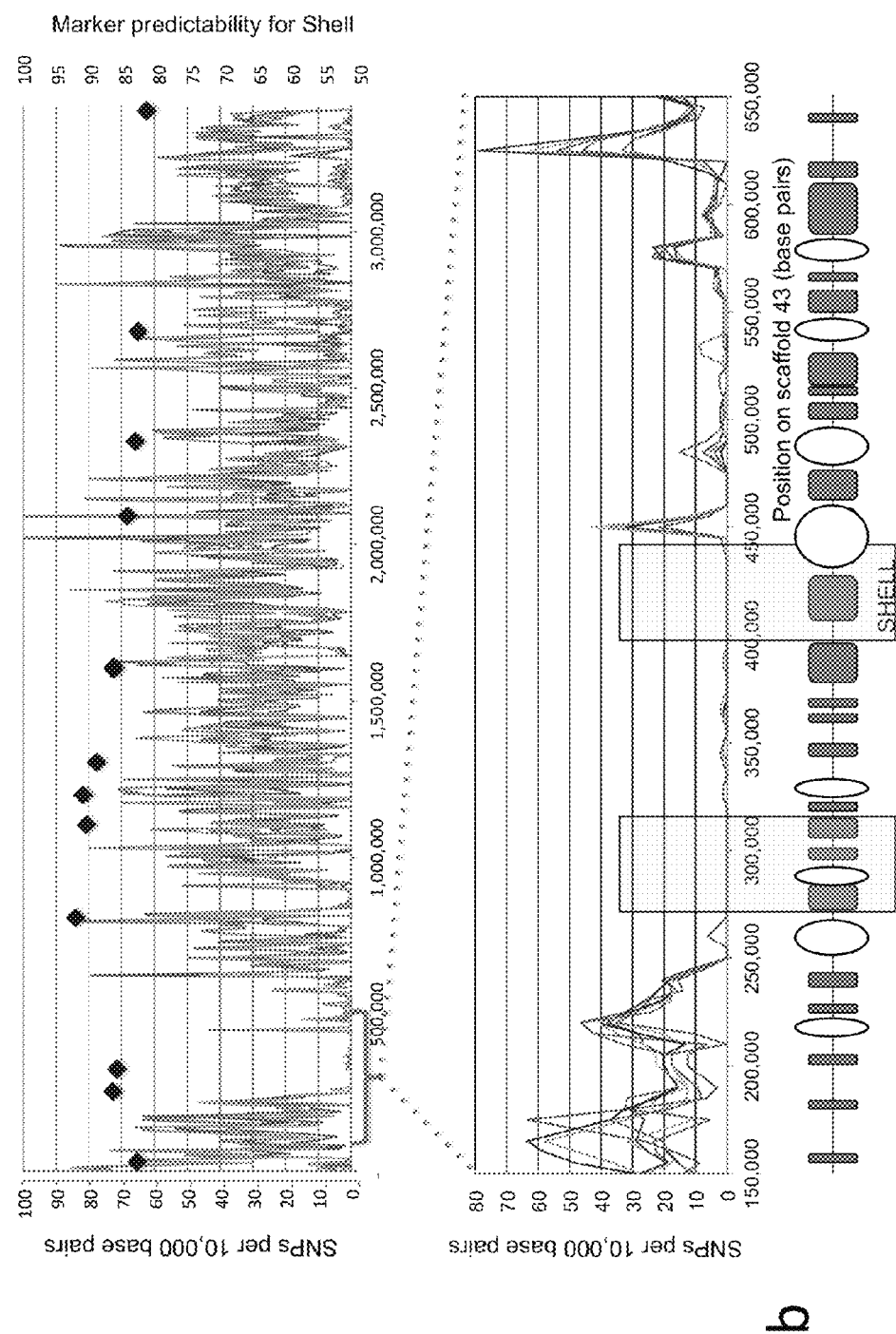
FIG. 4. Homozygosity mapping of the shell trait in oil palm. a, The SHELL locus was mapped onto scaffold p3-sc00043 (3.4 Mb) and SNP density was determined in 14 individual and 29 pooled *pisifera* palms from the AVROS pedigree and plotted along the scaffold (upper panel). Markers surrounding the SHELL gene are plotted against the % of *pisifera* palms with the SNP haplotype in the Nigerian T128 F1 mapping population. The SHELL gene was mapped to between flanking markers, (denoted by diamonds) at 400 Kb and 1 Mb. A local diversity minima of 200 Kb was found within this interval (inset). b, The local diversity minima contained 5 homozygous genes (boxes), only one of which was located between the flanking markers (SHELL). Unshaded ovals denote repetitive elements.

Next, we employed homozygosity mapping using the AVROS pedigree (FIG. 3) and whole genome re-sequencing. In this technique, candidate genes appear as regions with low diversity in homozygous inbred individuals (Gschwend et al., 1996; Lander and Botstein, 1987). Fourteen individual *pisifera* palm genomes were sequenced at 20× genomic coverage (Illumina HISEQ 2000) and 29 additional *pisifera* palms were sequenced as a pool at 40× coverage (pool 1). Individual reads were mapped to sequence scaffolds from the *pisifera* reference genome assembly, and highest probability SNPs were located on scaffold 43 of the *pisifera* Build 3 (p3-sc00043). In each of the 14 genome sequences, SNPs were summed over 10 Kb windows along the scaffold and plotted against map location. This scaffold was computationally annotated for genes by comparing to public databases for the *A. thaliana* and rice genomes using the NCBI BLAST™ similarity searching tool. The genes with the highest homozygosity within the predicted interval from the genetic map were screened for putative function and for nucleic and amino acid changes between the *pisifera* and *dura* lines, as well as for amino acid differences in other species. SNPs were called throughout the genome, and those in Scaffold 43 were scored. The resulting homozygosity plot had a local minima of 200 kb (centered around 400,000 bp in p3-sc00043, FIG. 4A). This 200 kb region contained about 30 annotated genes, only five of which were fully homozygous, and only one of which lay in the genetic interval containing SHELL (FIG. 4B). This gene encodes an ortholog of *Arabidopsis* SHPT, SHP2 and STK known to impact fruit development (Ferrandiz et al., 2000; Liljegren et al., 2000).

*Arabidopsis* SlHP1, SHP2 and FRUITFULL (FUL), for example, are Type II MADS-box proteins of the MIKC$^c$ class, and form a network of transcription factors that controls differentiation of the endocarp. In Brassicaceae, the endocarp comprises lignified cells that separate the valve from the replum and control shattering of the seedpod (Dinneny and Yanofsky, 2005). Failure to differentiate the endocarp in shp1 shp2 double mutants in *Arabidopsis* results in indehiscent fruit pods that do not shatter (Liljegren et al. 2000; Pinyopich et al., 2003), while mesophyll cells in ful carpels become lignified due to ectopic SP expression, and burst randomly when full of seed (Dinneny and Yanofsky, 2005; Gu et al., 1998). Interestingly, the ortholog of SHP in tomato controls fleshy fruit expansion in the endocarp (Vrebalov et al., 2009) while homologs of FUL and SHP have been implicated in split-pit formation in peaches, which are also drupes (Tani et al., 2007). SHP proteins bind to DNA as homodimers or as heterodimers (Huang et al., 1996), and the highly conserved MADS domain is involved in both DNA binding and in dimerization (Immink et al., 2010).

Figure 5:
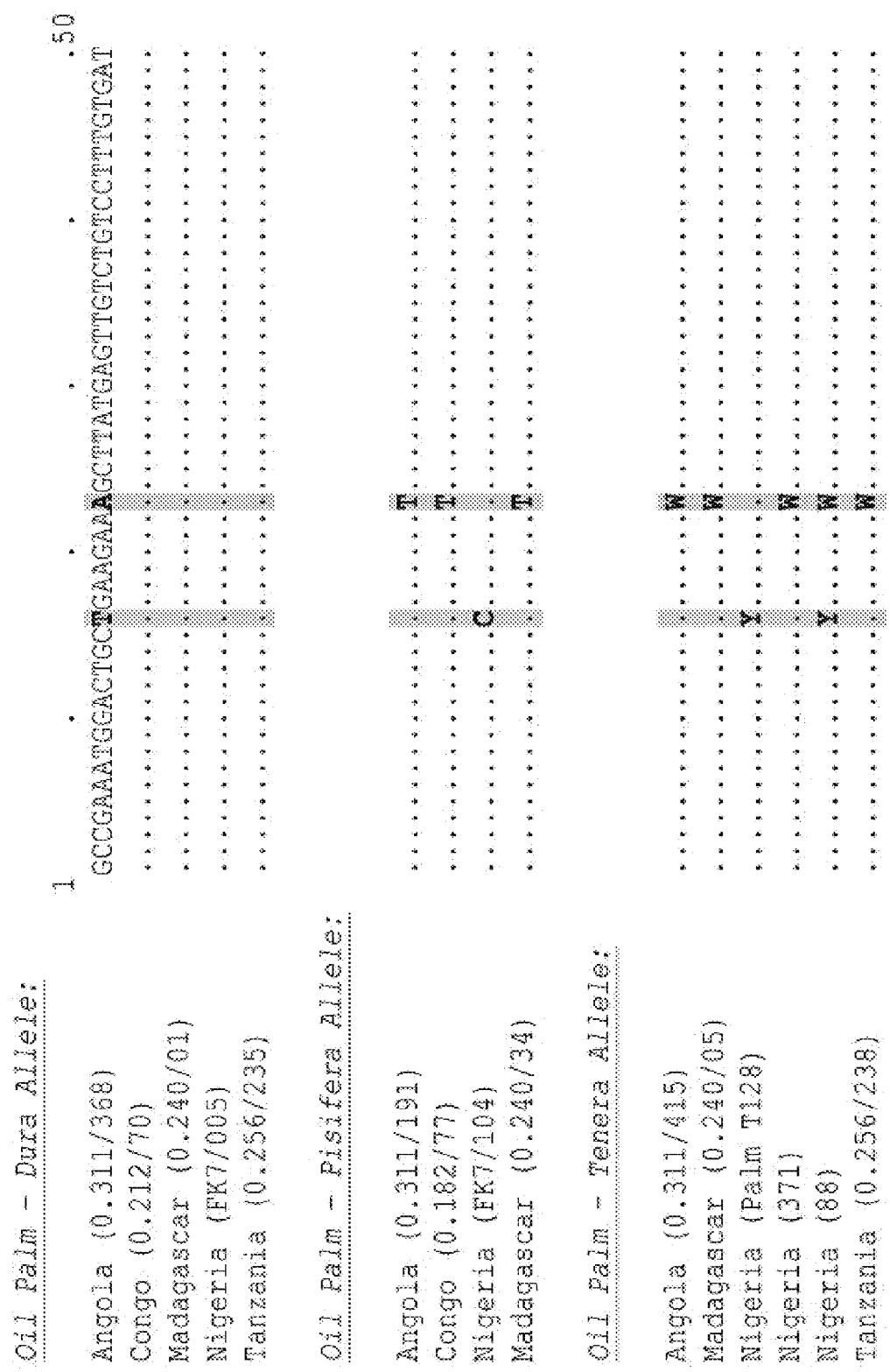
FIG. 5. Sequence conservation at the SHELL locus. Sequence conservation at the SHELL gene extends for 200 bp (not shown) either side of the shell phenotype causative SNPs (highlighted in grey) found in Nigerian (C/T=Y) and other African palms (A/T=W). Oil Palm—*Dura* Allele=SEQ ID NO:8223; *Pisifera* Allele Angola, Congo, Madagascar=SEQ ID NO:8224, Nigeria=SEQ ID NO:8225.

Analysis of 10,916,126 RNA-seq reads from 22 different oil palm libraries revealed only 159 reads matching oil palm SHELL, all of which were found in just four libraries: whole florets one day after anthesis, kernels 10 and 15 weeks after anthesis, and mesocarp 15 weeks after anthesis. These libraries correspond to the stages of shell development (Hartley, 1988; Bhasker and Mohankumar, 2001). PCR Amplicon sequencing (see Example 6) identified allelic differences between the SHELL orthologs in Deli *dura* (Sh$^{DeliDura}$), and those in the AVROS (sh$^{AVROS}$) and T128 (sh$^{MPOB}$) *pisifera* haplotypes derived from Congo and Nigeria, respectively (FIG. 5). The DNA sequence change associated with the *pisifera* fruit form in sh$^{MPOB}$ results in a leucine to proline amino acid change in the conserved DNA binding and dimerization domain, while the DNA sequence change associated with the *pisifera* fruit form in sh$^{AVROS}$ results in a lysine to asparagine amino acid change only two amino acids removed (FIG. 6). This highly conserved lysine residue is involved in nuclear localization, and in direct DNA binding by MADS-box proteins (Huang et al, 1996; Immink et al., 2010) while the substitution by a proline only two amino acid residues N-terminal to this position would disrupt the alpha helix structure that is involved in MADS dimerization and DNA binding (Immink et al., 2010) (FIG. 7). Analysis of an additional 336 palms was used to validate these alleles within established phenotyping norms. These included four *pisifera* palms from introgression trials of sh$^{MPOB}$ into *tenera* carrying the sh$^{AVROS}$ allele. Sequencing confirmed that these four palms were heteroallelic, indicating that the two alleles failed to complement, and confirmed the identity of the gene. Transgenic complementation experiments are not possible in oil palm, but similar experiments in tomato have confirmed the importance of the SHP gene, for example, in regulating mesocarp thickness in fleshy fruits (Verbalov et al., 2009). Therefore, the DNA sequence changes in the oil palm SHELL gene disclosed in this invention would have apparent effects on the function of the SHELL protein, thereby leading to the fruit type phenotype.

To further explore segregation in *E. guineensis* populations, SHELL Exon 1 sequence was generated from a diversity panel of 379 palms representing nine distinct wild oil palm populations collected from Angola (Rajanaidu et al., 2000), Madagascar (Rajanaidu et al., 2000), Nigeria (Hartley, 1988) and Tanzania (Rajanaidu et al., 2000), and a subset of a 110,000-accession seed bank collected over the past five decades (Rajanaidu et al., 2000) (see also Example 5). We found that all palms carried either the Sh$^{DeliDura}$, sh$^{AVROS}$ or sh$^{MPOB}$ alleles in exon 1 (FIG. 5). *Tenera* palms are thought to have been selected by pre-colonial cultures in West Africa due to their higher oil yields, and are the basis for modern oil palm breeding (Rajanaidu et al., 2000). The mutations we have detected in SHELL could account for these higher yields and for the remarkable single gene heterosis exhibited in *tenera* palms (Beirnaert and Vanderweyen, 1941). This is because the alleles would disrupt not only DNA binding, but also dimerization (Huang et al., 1996). Dimerization of the non-functional SHELL protein from shell-less AVROS (sh$^{AVROS}$) and T128 (sh$^{MPOB}$) *pisifera* fruit forms with the functional SHELL or other MADS box proteins from thick-shelled Deli *dura* (Sh$^{DeliDura}$) would be expected to reduce functional activity of the hetero- as well as the homo-dimer (Huang et al., 1996), resulting in the observed thin shell *tenera* phenotype in heterozygotes. Overdominance at a single locus accounts for similarly remarkable increases in hybrid yield in tomato (Krieger et al., 2010), and heterodimerization between transcription factors has been proposed to account for hybrid vigor in maize (Birchler et al., 2003).

Example 6

SHELL Gene Sequencing

DNA sequencing of the eight exons of the SHELL gene was carried out initially for 12 palms from the T128 selfed mapping population. Exon 1 of the gene was sequenced from all palms of the mapping family as well as the AVROS *pisifera* palms used in homozygosity mapping. In addition, Exon 1 from the palms listed in Table 5 was also sequenced.

TABLE 5

Additional palm samples used in SHELL Exon 1 DNA sequencing.

| No | Cross Type | Trial No. | Location | No. of Palms tested | Genetic Background |
|---|---|---|---|---|---|
| 1 | Tenera (T) × Tenera (T) | 0.305 | MPOB-UKM Station, Bangi, Selangor | 21 | 0.151/128 × AAR 0.127/13 |
| 2 | Tenera (T) × Tenera (T) | TT108 | United Plantations, Teluk Intan, Perak | 15 | Jenderata TT-Yocoubue × Nigerian Tenera |
| 3 | Tenera (T) × Tenera (T) | GGN | FFELDA, Jerantut, Pahang | 10 | T1791 (Nigerian selfed) |
| 4 | Tenera × Tenera | AA | FFELDA, Jerantut, Pahang | 9 | ML180T × 0.149/11525T (Yangambi × Nigerian origin |

[1]Palms on the left of the symbol 'x' denote the female parent, while the palm on the right is the male parent.
[2]In the populations listed above, the female parent of population 1 is palm T128, which was self-pollinated to generate the population used for map construction, in this study.
[3]Populations 1-5 above were segregating for the shell gene PCR primers were designed based on the reference *pisifera* genome sequence to amplify the entirety of SHELL exon 1 (SEQ ID NO:8237):

TTTTGATCTATGGAAATTAATAAGTCAATATGTCAGTATGTGAAGGTCTA

GGCCATGTTAGTCCCATCATTTCATTTATAGTTTAGATGATGATTTTTtC

TTTGTTCTTGGCAATATTCTAGACCAACTTCAGCAGACAGAGGTGAAAGA

GAGATCATGGGTAGAGGAAAGATTGAGATCAAGAGGATCGAGAACACCAC

AAGCCGGCAGGTCACTTTCTGCAAACGCCGAAATGGACTGCTGAAGAATG

CTTATGAGTTGTCTGTCCTTTGTGATGCTGAGGTTGCCCTTATTGTCTTC

TCCAGCCGGGGCCGCCTCTATGAGTACGCCAATAACAGGTATGCTTTGAT

GACGCCTTCTCTTCCTTCGCTCATATCAAGTTAATTTTATGGCTTCATTT

GTTCTATGGCCAAGCCAAATTCTTTTTAAAGTTCTAGAATGTTATGATGG

TAGTTTTGCTCCTCTTCAATTTATTT

Primer sequences were confirmed to be unique in the reference *pisifera* genome, and to avoid any identified polymorphic nucleotides. A 5' M13 forward sequence tag was added to the Exon 1 forward PCR primer (TTGCTTT-TAATTTTGCTTGAATACC; SEQ ID NO: 8238). A 5' M13 reverse sequence tag was added to the Exon 1 reverse primer (TTTGGATCAGGGATAAAAGGGAAGC; SEQ ID No: 8239). SHELL exon 1 was amplified from genomic DNA initially from DNA from 12 oil palm trees, and subsequently from a total of 336 oil palm samples (148 *tenera*, 100 *pisifera* and 86 *dura* and two palms where phenotype calls could not be made), PCR amplification was performed on 20 ng of genomic DNA under standard PCR amplification conditions. Amplicons were treated with exonuclease I and shrimp alkaline phosphatase to remove unincorporated primers and deoxynucleotides. An aliquot of each amplicon was sequenced using M13 forward as primer on an ABI 3730 instrument using standard conditions. Each amplicon was sequenced twice in the forward direction. An aliquot of each amplicon was additionally sequenced using M13 reverse as primer. Each amplicon was sequenced twice in the reverse direction.

All sequencing data was aligned to the reference *pisifera* genome sequence. Data were analyzed to determine the genotype at each of the two SNP positions identified to be associated with the *pisifera* fruit type.

At the SNP position of SEQ ID NO:922, *dura* trees were found to be homozygous for T (T/T), encoding a leucine amino acid at the corresponding position of the SHELL protein. At the same nucleotide position, *pisifera* trees were either homozygous T/T (if derived from the Zaire line) or homozygous C/C (if derived from the Nigerian line), encoding either a leucine or proline amino acid at the corresponding position of the SHELL protein, respectively. Therefore, *tenera* trees derived from a cross including Congo-derived *pisifera* should be homozygous T/T at the same position, while *tenera* trees derived from a cross including Nigerian-derived *pisifera* will be heterozygous C/T at the same position.

At the SNP position of SEQ ID NO:923, *dura* trees are homozygous A/A, encoding a lysine amino acid at the corresponding position of the SHELL protein. At the same position, *pisifera* trees are either homozygous A/A (if derived from the Nigerian line) or homozygous T/T (if derived from the Zaire line), encoding either a lysine or asparagine amino acid at the corresponding position of the SHELL protein, respectively. In addition, *pisifera* trees may be heterozygous C/T at the SNP position of SEQ ID NO:922, and heterozygous A/T at the SNP position of SEQ ID NO:923 as a result of having contribution from both Zaire and Nigerian derived lines. Therefore, *tenera* trees derived from a cross including Nigerian-derived *pisifera* should be homozygous A/A at the SNP position of SEQ ID NO: 923, while *tenera* trees derived from a cross including Zaire-derived *pisifera* will be heterozygous A/T at the same position.

Therefore, if derived from a cross involving Nigerian derived *pisifera*, *tenera* palms are heterozygous at the SNP position of SEQ ID NO:922 (T/C, where the *dura* derived T allele codes for leucine at the corresponding amino acid position and the *pisifera* derived C allele codes for proline at the same amino acid position), and they are homozygous (A/A) at the SNP position of SEQ ID NO:923 (where both alleles code for lysine). Conversely, if derived from a cross involving Zaire derived *pisifera*, *tenera* palms are homozygous T/T at the SNP position of SEQ ID NO:922 (where both alleles "T" code for leucine), and they are heterozygous at the SNP position of SEQ ID NO:923 (A/T, where the *dura* derived "A" allele codes for lysine and the *pisifera* derived "T" allele codes for asparagine at the same amino acid position).

DNA sequencing of the eight exons of SHELL was carried out for all palms of the mapping family as well as the AVROS *pisifera* palms used in homozygosity mapping. One of the 14 sequenced *pisifera* palms (TP10) proved to be heterozygous for the Zaire ($sh^{AVROS}$) and Nigerian ($sh^{MPOB}$) haplotypes, due to contamination in a breeding trial, and was not used for the homozygosity analysis. PCR primers were designed based on the reference *pisifera* genome sequence to amplify the entirety of SHELL exon 1. SHELL-specific primer sequences were TTGCTTTTAATTTTGCTT-GAATACC (forward primer upstream of exon 1; SEQ ID NO:8238) and TTTGGATCAGGGATAAAAGGGAAGC (reverse primer downstream of exon 1; SEQ ID NO:8239). Primer sequences were confirmed to be unique in the reference *pisifera* genome, and to avoid any identified polymorphic nucleotides. A 5' M13 forward sequence tag (GTTTTCCCAGTCACGACGTTGTA; SEQ ID NO:8240) was added to the Exon 1 forward PCR primer. A 5' M13 reverse sequence tag (AGGAAACAGCTATGACCAT; SEQ ID NO:8241) was added to the Exon 1 reverse primer. SHELL exon 1 was amplified from genomic DNA and PCR amplification was performed using 20 ng of purified genomic DNA under standard PCR amplification conditions. Amplicons were treated with exonuclease I and shrimp alkaline phosphatase to remove unincorporated primers and deoxynucleotides. An aliquot of each amplicon was sequenced using M13 forward as primer on an ABI 3730 instrument using standard conditions. Each amplicon was sequenced twice in the forward direction. An aliquot of each amplicon was additionally sequenced using M13 reverse as primer. Each amplicon was sequenced twice in the reverse direction. All sequencing data was aligned to the reference *pisifera* genome sequence. Data were analyzed to determine the genotype at each of the two SNP positions identified to be associated with the *pisifera* fruit form.

We sequenced SHELL Exon 1 from 336 individual palms from the T-128 mapping population, the samples used to construct homozygosity maps, and a collection of palms in crosses with advanced lines (100 *pisifera*, 148 *tenera*, 86 *dura* and 2 with ambiguous phenotype). 323 (96.7%) had SHELL genotypes concordant with their phenotype, and 11 (3.3%) had discordant phenotypes, reflecting the accuracy of phenotyping in the plantation (see above). SHELL exon 1 was also sequenced from all 4 *pisifera* palms derived from T×T crosses between Nigerian ($sh^{MPOB}$) and Zaire ($sh^{AVROS}$) (Felda AA and MPOB 0.305), and proved to be heteroallelic as predicted. An additional 3 *pisifera* palms were also found to be heteroallelic, including TP10 which was sequenced completely and proved to be a contaminant in the AVROS pedigree (see above). The other 2 heteroallelic palms were likely similarly contaminated.

A second attempt was made to phenotype and re-sequence the 11 apparently discordant trees, enabling the re-evaluation of 9 trees for fruit type. The second phenotype call of 1 palm was concordant with the genotype prediction, while the second phenotype calls of 7 palms were ambiguous, and I palm retained the original phenotype. This palm was re-genotyped and proved to have a consistent genotype. It is plausible that the 9 palms remaining (or 2.7% of the genotyped population) had been misphenotyped originally, given that fruit form phenotyping error is believed to be in excess of 5% (see above), highlighting the need for a molecular assay which more accurately predicts fruit form. This assumption was confirmed in 6 of the 9 palms for which haplotypes were available, as haplotypes were consistent with genotype not phenotype, ruling out recombination as an explanation for discrepancy. The map expansion immediately around SHELL is similarly explained by mis-phenotyped palms. That is, the 4 SNP markers closest to the mapped shell locus (see FIG. 2) surround the gene we have identified as SHELL, but all have 9/238 "recombinants" including 6 of the 9 mis-phenotyped palms.

Overall, a 2 to 3% discordance rate is within the range of the rate of incorrect phenotyping or genotyping based on either questionable fruit type classification or collection of samples from unintended trees in the field, respectively (approximately 5%). Furthermore, the two palms where the phenotype call could not be made were predicted as *pisifera*, by the SHELL genotype. This is in line with reports describing some *pisifera* palms as not being able to produce mature bunches—a trait observed for these two palms and the reason why fruit form could not be assigned.

In situ hybridization was performed on fruits between 1 and 5 WAA, at the earliest stages of shell formation (Singh et al., submitted). Uniform but weak hybridization signals were detected in the mesocarp of both the thick-shelled (*Dura*) and shell-less (*pisifera*) fruit forms, but very strong signals were detected in the outer layers of the developing kernel in only the *Dura* type, consistent with the function of Shell.

Therefore, the DNA sequence changes in the oil palm SHELL gene disclosed in this invention would clearly have effects on the function of the SHELL protein, thereby leading to the fruit type phenotype.

TABLE A

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 1. | GCAAGGTTTGAAGTACTAAAGTAT[G,A]GGGAGTCCTGTTCAGGTTTCGGCAC | 94,205 | 83 |
| 2. | CGGACAGCACATGGTACTTGCTGC[G,A]GGACATACCTTAGTATGCCTCATGA | 94,307 | 83 |
| 3. | AGCACTCGAGTTGGCCCTTAGTCT[G,C]TCACTTATAGTGGTAAACTTTGGGC | 94,566 | 83 |
| 4. | CAAGTGATTGTGATGAATAGTTGA[C,T]CCCATGCATTTTTAGGATCTTGTGG | 94,744 | 83 |
| 5. | GGCAAACCTTGAAAATTAGGAGTT[G,T]GGgAAGGTCTGGTTGGTGCAGTCAC | 95,576 | 83 |
| 6. | GTAGGCTATCAAAGTAACATTGTC[T,C]GTAGACTCCGTACTTTATATGAAAG | 96,098 | 83 |
| 7. | CTTTGAAATTTACCATTCATTATT[A,T]TAGGGTTAACATTTTCTTCCAAAAa | 96,236 | 83 |
| 8. | TTGTCTCCGCTGTAGCCACTATCA[G,A]ACACACTATGATCAAAGTTCACCTT | 97,720 | 83 |
| 9. | ATGGTTTGAGGTACCCCGGAACGG[A,G]CGCATACCAGTCACATACTGACATG | 98,326 | 83 |
| 10. | CTACTTGGACCTGGGTAATTTGGC[A,G]AaTGTGAAGCTGGCCCATCTATTGC | 99,241 | 83 |
| 11. | GGGGAACAGGGGAGGGCGAGGAAT[T,A]tGTGTAGTTTGCTATTCTTGGGGAA | 99,333 | 83 |
| 12. | GTAAAATAGGGAGAGGTGGAGGGA[C,A]GGAGAGGAGAAGAGGGTGGGAGGAT | 100,485 | 83 |
| 13. | ATAAAATAATGTGTTTTACATTGA[C,T]CcAATGTCATATCATCCAAACTTCA | 102,416 | 83 |
| 14. | TGTTCACCTTGATGGTTTTTTCAG[C,T]GTTCAAAGAAGATAATTCCCTTTGT | 103,291 | 83 |
| 15. | TAGCAGGCTTAGTGAAACCAATGA[G,T]TATCCAATTACTGTGGGCAATCAA | 103,497 | 83 |
| 16. | TTGTCTTAAATCTTACCATCCTCA[A,G]TGTGTGGGAAGGATCCTTCCTTCT | 104,201 | 83 |
| 17. | TATGGTTTGCCGAACTGCCCCAAA[T,C]GGTACTGGTGGCCAACTGGCGATGG | 105,803 | 83 |
| 18. | TATGTATGCACACACACACACACA[T,C]ATATATACATACTTATATATATAGG | 110,017 | 83 |
| 19. | GAGAAAATAGAAGGGGCTTATGGG[A,C]TTTGGCTGGGATTCCTAAATTGAAG | 111,511 | 83 |
| 20. | TGTTTAAGAGTACTATTTTTGAGT[C,A]TAACGAACTAATTTACGGAAAAGTG | 111,781 | 83 |
| 21. | GGTGGCCACCGCCGATGCCTCTAC[C,T]GGTCTCCCTTTTCTTTCCTCCCTCT | 116,728 | 83 |
| 22. | TCTTAACAGTTTGGATTTTTtCTT[T,C]CTATATTTTAATAAGCTCACCCTAA | 117,200 | 83 |
| 23. | TATAGGGTTGGTTCAGCATATGGA[T,C]GCTCGATATGTTGCACGTACTGAGT | 117,367 | 83 |
| 24. | CAGTTATGTTACTCGTGAGGAATT[G,C]CCATTAGGATAAACAAAAGGTTCAT | 118,689 | 83 |
| 25. | ATTCAGTCTAAGTGTCCTTTATCC[A,G]TTTCTTCCTGTTATTCCAATGCTAT | 120,124 | 83 |
| 26. | GCACTGCATGTATGTTAGCATGGC[A,G]CAAAATGTTCCTTGCcGGCCTTTGG | 120,464 | 83 |
| 27. | AGCATGGCaCAAAATGTTCCTTGC[C,T]GGCCTTTGGCCAGAACGCTTCATGC | 120,480 | 83 |
| 28. | GGCCAGTCCAAGAATGTAGTTCCC[A,T]aTTGGTATAGTGGGAAGAATACAAA | 121,782 | 83 |
| 29. | TCTCGTTTCAAGAATAAGTCACTA[T,C]GATGATTAGATATGAAATATGGTGA | 122,461 | 83 |
| 30. | ACGCCCACGACTAAGTTCTTCGCC[T,A]GTGCCTCAGACTTCGAGAAGACCAG | 122,933 | 83 |
| 31. | GTCTAGTAGTCCCTCTTTGAGACA[C,T]CGCATCTCGGCAGAGACTTGTTGAT | 123,051 | 83 |
| 32. | GTTACTGTTGCTGAGATAGCTCCT[C,T]AGTCTGTTGTCGAAGTGGCTCCTCA | 123,865 | 83 |
| 33. | TCAGTCTGTTGTCGAAGTGGCTCC[T,C]CAACCGCTGATCGAAGTGGCCCCTC | 123,888 | 83 |
| 34. | TTTTtATCCGATCTCACCTAACCC[G,A]ATCTTGGTTTAATTGTCATATATAG | 124,168 | 83 |
| 35. | TCCTCATTTGGTCGGACTATATGA[C,T]cTTATTTGGACAATTATTTTATATC | 124,799 | 83 |
| 36. | AATTCTCAATTCTATATGCTCCCA[A,G]GCGGATTACTTCGGTAACTTGGTAG | 125,025 | 83 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 37. | ATTATCAGTGATAATGATTTGAGG[C,T]AAATCAAAGTGGCAGACAATTGATT | 125,609 | 83 |
| 38. | GAAGAGTTTCGATGCTGGATTTTT[T,C]GAGGTAGTAGATAAGAATTTTTAGT | 126,221 | 83 |
| 39. | TCAAAAAaTAGGCTGAACTGGACC[A,G]AaCCAGTGGGTTCGGTATGGTATCA | 126,634 | 83 |
| 40. | TATGATATCGGTTGGCAATCGATA[T,C]GGGTTTTGGTATCAAgTCCGCAAAT | 126,840 | 83 |
| 41. | AATCGATAtGGGTTTTGGTATCAA[G,T]TCCGCAAATCTTGGTTTGAAGTATT | 126,856 | 83 |
| 42. | GGACATTCAGGGACAATACCTTCA[A,G]GATTAGCTAAAATTAAACCAGCTCC | 126,920 | 83 |
| 43. | ACTTTAGAGGTTGATCATTTAAGA[C,T]GACGATTGAGTGGGCTTGGAAATAA | 127,203 | 83 |
| 44. | ACTTCAACTGGTTTGGACAATAAT[T,G]GGGGTGAATCGAGATATTTCTTAAG | 127,436 | 83 |
| 45. | CGGTGTAATCAATACAAATCCTCC[A,G]GTTGTCATTTGCATTTTTGACCATA | 128,135 | 83 |
| 46. | GCTCCGAATCAACATTCAATTTAT[C,G]TACAATAACATTGGCAGAAATTCCA | 128,316 | 83 |
| 47. | TGAAGAAAAGATATCGGTTATTTT[T,C]TtAAATCAGTCCTTAATTGAGATCC | 128,408 | 83 |
| 48. | GTGGTTATAGGCAAAGTGATTTCT[C,T]cTTCAGCAGCTACGGGATTTTCAGA | 128,816 | 83 |
| 49. | GAGGAGTTTGGACTTCTTGAACAT[C,T]AGTATCAGAAAAAAAAaTAACATTG | 129,023 | 83 |
| 50. | GCCTGAGCATACTTTTGGATTCGG[G,A]TTAGCATTTGATCGTAGGTGTCCGA | 129,583 | 83 |
| 51. | GTTGTCCGATCCCATCTCAACAGC[C,T]ATTTCGATCATGCATTCCGATAGAT | 129,605 | 83 |
| 52. | CTGCTCCCTTCTTTTATTTCTTTC[A,C]TTTTTCTTTTtCTTCTTTCCTTCCA | 129,891 | 83 |
| 53. | GACTCATTGAAATTTTTGACTTCA[A,C]GCATGACGTATTGAAGTGCACTGTA | 130,161 | 83 |
| 54. | AAAATTTCTTGAGAAAAAaGGGAT[C,T]GTAGGTCAAAATCTTGCTTATCTTG | 130,535 | 83 |
| 55. | TATCTTGGGAATGATTCCCAAGTT[A,G]TACTTCCATCAGCCGTTTTTCAAGA | 130,578 | 83 |
| 56. | GGATCTTGATGGATTGGCTGATGA[T,C]TGTGTTGGGACAGAACTTTTTGAGG | 130,733 | 83 |
| 57. | TTGAGGAATTGCCTCTCATTGCTG[T,C]TTTATGGTACATTGGAGTTGTTGTA | 130,777 | 83 |
| 58. | TGAAGGTTGAATAGCTTCTGGTCC[G,A]CCTCTTGGAGAAGATGGTGAAGGCA | 130,890 | 83 |
| 59. | GAATTATTGTGCTTTCTAATTTAC[C,T]ATTTTTCACAATCTTTTGGGCAAGC | 130,942 | 83 |
| 60. | TTTATGGTTTTTAAACTATGGCTT[G,T]GATGTTAACAGATAATGAAGCTGCC | 132,949 | 83 |
| 61. | TTCATTTTTTGACTCCTTTTTTAA[G,C]CCAGGTTTGCTCATCATTCACTTAT | 133,628 | 83 |
| 62. | ATCTAACGGGGCTAGCCAAACCAA[T,C]GCTCCATCTGAGCTATCTGATCCCT | 134,691 | 83 |
| 63. | TGCAGAAATAAGGTTGGAGTTGGA[C,A]AAAGTCAGAAAGGTGGCACAAAAGA | 135,827 | 83 |
| 64. | CACCATGGCTCAATCGAAGCGCCC[G,A]CGTGCTGAAGCTTTTGAGGGTCGAT | 135,896 | 83 |
| 65. | TTTGTTTTGTAATTTGGATTGGCC[A,G]aTCTTTTGTACCAGAGTAATATTAA | 137,583 | 83 |
| 66. | AACCTTGTTGTATGATGAGCTGAC[T,C]tGTTAGTAGAAAGATTCTTAAGTTC | 137,652 | 83 |
| 67. | CAGCTTGGCTCGACTGGGTCATA[G,A]CTCCAAGCTTATTGAAGGGGTTCTC | 138,012 | 83 |
| 68. | TACATCCCGTACCAAACCATACCA[A,G]TGGGGAGCTGGTCCGATTTAGACTG | 138,124 | 83 |
| 69. | GATTGAACCGATCGGTTCAGTACG[G,A]TATTGGCCCGAACCGTCCGATGTCA | 138,199 | 83 |
| 70. | GTTTGATCCAATTCGGTATGGTTC[G,A]AAGCTGGTTTGATTCGGTTCGGTCT | 138,253 | 83 |
| 71. | GTGGATTGAGTTGGCTTTGCCGAT[A,C]TATGGAGCTTCCGAGGATCCTCTTA | 138,568 | 83 |
| 72. | TCAAATGATTAAGATTTTTAGCTC[C,A]GCCATCAGGGATAAGGGGCTATTCG | 138,637 | 83 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 73. | GATTTTGGAGCTTCCAAGGATCCT[T,C]TTATGGGGTTATGCCTCACTTTTTG | 138,927 | 83 |
| 74. | CATCCGCTCAAGATCCATTGGCCC[G,A]ATCCAACCTTGTCTTTAGGCCTTGC | 139,645 | 83 |
| 75. | TATGTTTGTTATCTCCTGCTTTAT[T,C]tGGTGAGATATGTTTGTTATCTCCT | 145,595 | 83 |
| 76. | GTGAGATATGTTTGTTATCTCCTG[T,C]CTTATTTACTCGTGGCAGGTTGTTG | 145,622 | 83 |
| 77. | TTCTGGCTGCATCAACCTTTCAGT[G,A]AAGCTACTATTGCTTTTTtAGTTTC | 146,302 | 83 |
| 78. | TTCTAATTATTTTAGTTTTACAGC[C,T]GCACGGATGTTACCTTTGTTGTTTT | 146,487 | 83 |
| 79. | GTTATTTGCCACTCTTGGACCGAC[C,T]GTCAGTTTTCCATAGTTTCTAGACA | 146,576 | 83 |
| 80. | TCTGTTAGGACTGTTTATGAGCAA[T,A]GATATTTTCTGTGCATTGTCAATAT | 147,611 | 83 |
| 81. | TGGCATTGCGCATGCCCAATTTTC[G,A]TATCCACATGGGCCTCTCTTGAAAG | 147,666 | 83 |
| 82. | AAGTTTGGAAGCTACTTATGGCTA[G,A]GATGTTCCAAATGGCTGTAGCCACT | 147,923 | 83 |
| 83. | ATGGCTAGGATGTTCCAAATGGCT[G,T]TAGCCACTCTGTTTCATGGTAGAAT | 147,940 | 83 |
| 84. | CTGCAGGAATCAGGTGCATATAAT[A,C]aTTATTGAAAGAAGAGACAGAAAAC | 148,413 | 83 |
| 85. | CATTGATTTAGATGAAGATGAAGA[T,A]GACTGCTCAACTGCCTTAAAGGAAA | 149,495 | 83 |
| 86. | ACTTCTTAGAGTATAAATTTGAAG[C,T]GAGTTGTTTTCCTCTCGGGAGATAG | 156,804 | 83 |
| 87. | GGATTATGAAGGAATATGTGATGA[T,G]CTGTTTCTTTGAAGGTTGTTTTCTC | 158,166 | 83 |
| 88. | TGCGAGCTGCTTATCAGGTTCCAC[A,C]TGTGAGCCACAAAGTTAGGTACACT | 158,405 | 83 |
| 89. | GCAAGTGTTTAGATCTACAGAATC[T,A]TGCATCTCTAGCATGTGTCTGGGTT | 158,473 | 83 |
| 90. | ATTGTTGGAATTTTGCTACTGGAA[C,G]TTTTGCTAGaTGCACGGTCTGATTC | 161,181 | 83 |
| 91. | TTTTGCTACTGGAAcTTTTGCTAG[A,T]TGCACGGTCTGATTCACTGAGATTG | 161,191 | 83 |
| 92. | TAGTTTATTCAATATAATAAATTC[C,T]ACGACTTCAACTTCTGCACCTGTAT | 181,615 | 83 |
| 93. | CCACCAAACAACTAGAATTGGAGC[C,T]ATTTATTTTCATTCTCCTTCTACAG | 182,673 | 83 |
| 94. | CTAGGCCTTGGGGACTCTAACTCA[A,G]ACGAGACTGGGATCCCGTATTAGGC | 186,051 | 83 |
| 95. | TACCCCTATTGGCCCACAGAAATC[A,G]ATAGTTGGCTTATTTATGAGTAACA | 186,644 | 83 |
| 96. | AAAAGGCACAAGCACGTCATAGTC[G,A]TAATAGAGGCGTGTCTTCTGCAATC | 186,787 | 83 |
| 97. | CTAGGGTAACGCTCGAACATCAGA[C,T]GCAGATCCAAAAAAaGACTTGAGCC | 187,294 | 83 |
| 98. | TCTTTCCTCACTACTTACTGGCTA[C,A]CGCATTTGGGAGAGTCAACTCCCAT | 187,401 | 83 |
| 99. | CATCGGATAAGATGACGTCCGCCA[C,T]CAAGGTCCAAATAGGGAGGAATGGT | 187,557 | 83 |
| 100. | TTCTCTCAGAATCAACTTCGATCG[G,A]AACTTATTTTGTAGATCACACTGCT | 187,872 | 83 |
| 101. | TTAACTTGGAATTTTTATGTTAG[C,T]AAAAGCAACAAATTTTTCTCTCGA | 188,731 | 83 |
| 102. | TCTCTTCTGCCCCCCTTTGATCCT[C,T]TTGTGTGCTTGCAAATCTCTATCAA | 201,006 | 83 |
| 103. | TTACTTCTTCCATCAACTTGGAGC[T,G]GTTGTCGATCGGTATTTTGCTATCG | 201,220 | 83 |
| 104. | GCATTTCAAAATCTAAATATGATC[C,T]GCAGCGTATACCAACAATGGTTGCA | 202,350 | 83 |
| 105. | GGAATGAATGATTGTTGCTTTTTt[C,T]TTTTtGCATCTAACTTGCATCATTC | 202,626 | 83 |
| 106. | GTGATCAGGGAGGAATTATTCTGA[C,G]ACTACCACCAGGGCATCCTTGCTGC | 203,394 | 83 |
| 107. | ATGAATTCATCATTCGTTTTGTCA[T,C]TTTAAGTTCAACAATGCCATTGGGT | 203,652 | 83 |
| 108. | TTAAGTTCAACAATGCCATTGGGT[T,C]TTTATCTCCTCGATGTTGGTAGCAG | 203,678 | 83 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 109. | GGGTTTTTATCTCCTCGATGTTGG[T,G]AGCAGCTTAAATATTTCTTTTCATG | 203,698 | 83 |
| 110. | AGCTTAAATATTTCTTTTCATGCC[T,G]TGAAAGTGGTTGGCAGTGTTTGGTG | 203,726 | 83 |
| 111. | GAAAACATGTTCTATGGTTTCTAT[G,A]TCAGGTTTTATTAGTGTAAGAGAAA | 203,943 | 83 |
| 112. | GGACATCAACTCAGAATGCCAGTT[G,T]GAAGGGTTAATGCTTCTAATAAGCC | 204,699 | 83 |
| 113. | CCCTAAAAGATGAAGGCATGACTC[A,G]GTACAGGATTCATAGACCTTCTTAA | 213,142 | 83 |
| 114. | TGAGCCCCTAAAAGATGAAGGCAT[G,T]ACTCAGTACAGGATTCATAGACCTT | 213,147 | 83 |
| 115. | TTTAAGTGACTTGATTAAGAAATT[A,G]TGAAGCACAGATTAAATCAAGATCA | 213,308 | 83 |
| 116. | ATAAGGAAAGATGACTGTTGTCTG[C,G]ATGTGTCGGACCATCCAGATACCGG | 213,390 | 83 |
| 117. | TCAAATCATCATTAATTTCTATTT[T,C]ATGAATATAATAAGATTAAATCATA | 213,437 | 83 |
| 118. | TTACCTCGTTCATTTTAGATCTTC[A,T]GACTTCGTTAGAAGAATCAACTAAT | 213,500 | 83 |
| 119. | TGATTATTTAAAAATAAATAAAGA[A,G]CGTAAGATCCACTTACCTCGTTCAT | 213,537 | 83 |
| 120. | TTTTTCATATCACACGTGCTGATC[C,T]TTATTTTATAAAAAATATGATTTCA | 213,615 | 83 |
| 121. | AAATATATTCATAAAATCAATGCT[C,T]ATAATAAAATATAATTTTTCATATC | 213,654 | 83 |
| 122. | TTTATATCTTTTTTTtAAAGCATA[C,T]ATATACATAAATAAAAAAaTAATAA | 213,736 | 83 |
| 123. | ATACCCGTTGGCAGGGCTATGTTT[C,T]GTGTGGATGCTAGCTCTGGATGTCG | 213,834 | 83 |
| 124. | CTATTATACCTGTGATAGGGCCAT[A,G]TTTCTTAATCGACAGAGTTCTTAAT | 213,899 | 83 |
| 125. | GATATATTGCTCCCAGATATTCGT[T,G]CTAAGATCACTATTATACCTGTGAT | 213,933 | 83 |
| 126. | AATCATGAATCATAAATCATTCTT[A,G]TCATGTATTCATGTCAAGTTTTGAT | 213,980 | 83 |
| 127. | ATATAAAATAAAATATTTCATAGA[A,G]CATATAATAAAATAAATTATAAACC | 214,063 | 83 |
| 128. | ATATTTAAAAAaTAACAGATAATA[T,C]AAAATAAAATATTTCATAGAACATA | 214,084 | 83 |
| 129. | ATCTAAACCTCATCTACAAAATTT[C,T]CAAGCTTGCATCGCAGATCTCTAAA | 214,264 | 83 |
| 130. | CTAAATCCAAAATCAAATATAAAT[T,C]CATATATCAAAATCCATAATTACTT | 214,338 | 83 |
| 131. | AGCATCTAAATCCAAAATCAAATA[T,C]AAATTCATATATCAAAATCCATAAT | 214,343 | 83 |
| 132. | CCATGATAACACGAAGCCAATCCA[A,T]CATAATCATCCAAAATCCATCAAAT | 214,444 | 83 |
| 133. | ACATAACACGACCATGCTACCGAA[G,A]GATGGAGCCCATGATAACACGAAGC | 214,477 | 83 |
| 134. | AGGGTTGATCTGAGTACGAGAAGT[G,A]TTAACTCTGGAATGAAGTGGGAGGT | 215,375 | 83 |
| 135. | AAGGACATGATAACTTTGCTGATT[T,G]TGATGTTAATTTTTTtGCAAAAAAa | 215,483 | 83 |
| 136. | AAGCATGATGGTCTGAATTAATTA[A,G]AAaTATTAATCTTTTAAATTAAAAG | 215,843 | 83 |
| 137. | AATACGTTAGTTATAAATAAGGAA[G,A]GATTTTACTGATAATAAAAGAATGC | 215,902 | 83 |
| 138. | GAAGGATTTTACTGATAATAAAAG[A,G]ATGCTAGAGAGAAAATCTATCTGAT | 215,923 | 83 |
| 139. | AGTCAACGATATATTAGACCTTTT[G,A]AAATTTTAAGCCGAGTAGGAGATGT | 216,121 | 83 |
| 140. | CACAATGTCTTTCATGTTTCATCA[C,T]TGAGAAAATTTATACCTGATCCAAA | 216,211 | 83 |
| 141. | ATGTCTTTCATGTTTCATCACTGA[G,A]AAAATTTATACCTGATCCAAATAAT | 216,215 | 83 |
| 142. | CATGTTTCATCACTGAGAAAATTT[A,G]TACCTGATCCAAATAATGTGGTAAA | 216,223 | 83 |
| 143. | TAAAATTTTAAATAAAAAAaTATC[T,C]TTCTTATTCTGAAAAAaTTATGACA | 221,260 | 83 |
| 144. | CTTTATGACTTTTGAAAGAAAAaT[T,C]AAGACATTCTGCATGTAAAAGTCA | 221,443 | 83 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 145. | AAACCATAGATCATCTCATGACTC[C,A]ATGTGAATACTCCTATCTCACATAA | 221,900 | 83 |
| 146. | CATGACTCCATGTGAATACTCCTA[T,A]CTCACATAAAAACATCTGCTACAAC | 221,916 | 83 |
| 147. | TTAAACTTAATTTAATACCCCCTC[G,T]TGACAGCCTCTAGGCTCTTTCCTCA | 226,490 | 83 |
| 148. | TCTAGGCTCTTTCCTCAATTTCTT[A,T]ACTTATTGTTTTTATTCTTCTTTA | 226,523 | 83 |
| 149. | AGCTTCCTGTATTTGGCCACTCTG[T,C]CTCCTCTAAGCTTCCATATTTGGCC | 229,627 | 83 |
| 150. | CATTATTTTTTCAGAGATCTGCAG[G,A]AAAGGAGAGCACTTGAAAGAGATTA | 229,844 | 83 |
| 151. | TTTAGCAGTTATTTTTTCGATATA[A,G]TCTCAATGCTACAGACTCTTTAGTT | 230,883 | 83 |
| 152. | CAGTTATTTTTTCGATATAATCTC[A,G]ATGCTACAGACTCTTTAGTTTATGT | 230,888 | 83 |
| 153. | AGCCTAGTAAATTATCGAAGTTAT[C,A]TATAATGATGTGGGATGACAACATG | 230,950 | 83 |
| 154. | TGCTTAGTTGTCTTCCTTCTGTAA[T,G]GACCACACATGAAGCACTCCAGACC | 235,235 | 83 |
| 155. | ACATCTGCTCTTCCTATCATGGAC[C,T]GAAAAATTGTCAGCATAAAGACATA | 235,370 | 83 |
| 156. | TCAAGAAAATCCCAGCAAATACAG[T,C]TTTtCTGAAACAATCATAAGATACA | 236,194 | 83 |
| 157. | GAGGAAATGGCTCGACCGAACAGG[G,A]TAGAACAGGGTCTCGCCTTTTCATC | 238,549 | 83 |
| 158. | AGGAAATGGCTCGACCGAACAGGG[T,C]AGAACAGGGTCTCGCCTTTTCATCA | 238,550 | 83 |
| 159. | GAACAGGGTAGAACAGGGTCTCGC[C,T]TTTTCATCAATTTTTCCAACGATCC | 238,566 | 83 |
| 160. | AAGCCATGGGAAGGAGGGAAGGA[G,A]GAGAGGAAGGAGGGCCGGGGCTTAC | 238,638 | 83 |
| 161. | TTCAGATTCGAGGAAATTTAACTG[A,G]AGTCTGAATTCTAATAAGATGTGAA | 239,157 | 83 |
| 162. | TTATTGCAGTTGTATTTGTTGGAG[C,A]CATTGGGGGTATATTTGGAAGTCTA | 239,926 | 83 |
| 163. | TTGTTGTCATTCTTGGATTGTGTT[G,T]ATATACTCTAGACATTAGCTTAAAT | 240,051 | 83 |
| 164. | GTTTCTGACAGGGTCTAATTATTT[G,T]CAGGAAAGGTGCACCTTTCAAGATC | 240,153 | 83 |
| 165. | TCTTGGTCTCCATGAGCACTGTCC[T,C]ACCGTTGGCCGCTCAGGCAACTTCA | 240,283 | 83 |
| 166. | CAACTTCAAGAACTTTCAATGCCC[A,G]CAAGGTCATTACAATGACCTTGCTT | 240,325 | 83 |
| 167. | TATTGAAACAATGTCTCTAGCCAA[G,A]GCTGCAGTGCTCTTCAGAGAGCTTG | 241,225 | 83 |
| 168. | ACTAAAAAAaTCTTGACCCAAACC[C,T]GAGCCAGATGCGAAAAGATGTAAAA | 242,216 | 83 |
| 169. | GTTAAATGAAGTGTCAATGCTCTT[A,C]TGAAACCTGAAATCTGTTTTCTTGC | 242,494 | 83 |
| 170. | TtCTTCTTTTAAGCTATCAAAGAG[C,G]CCCCTCCACAGAGTTTGTTGAGGCT | 244,290 | 83 |
| 171. | ATTCTCCACCAGATAGCTGCATGA[T,C]ATTTCTTGTTGTTTCTGCTTATTGC | 244,369 | 83 |
| 172. | GGACAACAAATTACAAGGTAGAAC[T,A]AGCAAAAATGACTCGACGACTGCCA | 244,511 | 83 |
| 173. | AACCTTCTCAGCTAAGAAAGCAAT[G,A]TTTTTTACCGCCCTAATTTGCCAGA | 244,560 | 83 |
| 174. | CATGCATTTCCAGGTATTTAGATC[C,T]GGAACGGTGGCAGGCACTGCCATCC | 244,685 | 83 |
| 175. | ATTTCCAGGTATTTAGATCCGGAA[C,T]GGTGGCAGGCACTGCCATCCATCAA | 244,690 | 83 |
| 176. | AAAACTAAAAGCATATTTGATTCA[T,C]GATCGAAATTAGAATCAGAATCGAA | 244,802 | 83 |
| 177. | CAACCAAACATGCCTTATAGGAGC[A,G]AGGCAGAGAGAAATTCAGTGACTAG | 245,088 | 83 |
| 178. | TCATCTCTCCTCTCAAACACCCAT[A,C]TCTCTCCTCCCGTTTTGCTGCTTTC | 245,235 | 83 |
| 179. | CCGTTTTGCTGCTTTCCTCCAAAA[G,T]TACAACTTCATCATTTAGTAAATTG | 245,269 | 83 |
| 180. | TATTTTAGAGAGAGTAAGCTTAAG[T,C]GAGAAAGTCTCTTGACTAAAAAGAT | 245,406 | 83 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 181. | ATGGAGCTTGATCCTAAGGGGTCC[A,G]ACTGAACAAGTCTCTCATGACTAAT | 245,516 | 83 |
| 182. | GGGGTCCAACTGAACAAGTCTCTC[A,G]TGACTAATCTTCATGAGGATTCGAA | 245,533 | 83 |
| 183. | CAAATTTTTGCTCGTGGTCCCTTT[C,T]CTTTGGCCAATTAACTTATAGCTCT | 245,964 | 83 |
| 184. | CCTTTCCTTTGGCCAATTAACTTA[T,C]AGCTCTCCAAGAATGATGATCTAAT | 245,983 | 83 |
| 185. | ACCAGGTAGAAATACTATTAATCA[A,G]GTAGCCATTTGGTTGTGGATGCCTG | 246,038 | 83 |
| 186. | TAAGAGTTTGTTTATAAAGAGTTA[C,T]CGAATCTCTGCTAGCCATGTAACCA | 246,277 | 83 |
| 187. | CTATGCTTCCTGTAAAAATCATGA[A,T]CTGGATAGCTCCTTGCCCAAGCCTA | 246,339 | 83 |
| 188. | ACCAGATCATCGTCTATTGGTGTT[G,A,T]CTCTTTTTGTGTTTCAAGCTTCGAC | 246,448 | 83 |
| 189. | CTCCAAAGACTCTAAAAAATTCAA[C,T]AGATCAAATGATTTGATTCACCCAC | 246,722 | 83 |
| 190. | GTTACAAGTTGAGTTGGGCCTAGA[A,G]CACACCTTGATTGAGCAGTATGTCA | 246,993 | 83 |
| 191. | TCTGAAGCTTTTAGTGCCCAGACT[C,T]AATCTCAAATAAGCTCTATAGGGGC | 247,056 | 83 |
| 192. | CTCAATCTCAAATAAGCTCTATAG[G,A]GGCGTGTCTTTCCATATCTTAGTAT | 247,078 | 83 |
| 193. | CATATGCATTGTCTAGATATTTGT[T,A]GTATCCTAGAAATATATTTGTCTAA | 247,199 | 83 |
| 194. | GGGTTTTCAAAGACCTATGTTTAC[C,T]TGGTGTAATCAACTAGGATCTA | 247,649 | 83 |
| 195. | TCTGAGCTCATGGCCGGTCATTTT[G,T]CTTCTAATCATTGTCCTTCATTGAT | 247,758 | 83 |
| 196. | TAGGCCTAAACCTTTTTGGTTTGA[G,A]AAATTTTGACTCTCCGAGCACATAT | 247,831 | 83 |
| 197. | ACAAGGAACCATTCTTCTGGTGTG[C,T]GACTTTCTATTGTTCTACATAACAC | 247,912 | 83 |
| 198. | GCCTTAGTTGATGAAATCATTGTC[A,G]CTTAGGTAACTTTTTTTCAAGTTGGT | 247,970 | 83 |
| 199. | CTAATAATAAGTTGGAGTATCTT[C,T]AGTTGAAGGAAGTCTCTTATAGTGG | 248,026 | 83 |
| 200. | TATCTTCAGTTGAAGGAAGTCTCT[T,G]ATAGTGGTTTGCCTCATTAAGATCA | 248,044 | 83 |
| 201. | AGTGGTTTGCCTCATTAAGATCAT[A,T]AGGATTTAACTGCACACCCTTAGGCT | 248,071 | 83 |
| 202. | AAGGATTTACTGCACACCCTTAGG[C,G]TTATAATCTTGACTTGAATCAATA | 248,095 | 83 |
| 203. | CACACCCTTAGGCTTTATAATCTT[G,A]ACTTGAATCAATAAGAAATCTTCTG | 248,107 | 83 |
| 204. | TAGAATTTCGTGGCTTAAGGAAGA[A,T]AATAGTAGTACTAAATTTTTTCGCT | 248,169 | 83 |
| 205. | AAAATAGTAGTACTAAATTTTTTC[G,A]CTACTCTACTATACAGAAGAGAAGA | 248,192 | 83 |
| 206. | TTTTTTCGCTACTCTACTATACAG[A,C]AGAGAAGAGCTACTAAAATTACTAA | 248,209 | 83 |
| 207. | ATTAGATGGATCTAAAGTTGACGA[C,T]GATGTTATGATTCATCAATTTGTAT | 248,268 | 83 |
| 208. | TAAAGTTGACGACGATGTTATGAT[T,G]CATCAATTTGTATTCACTTATTTTA | 248,280 | 83 |
| 209. | CTTAAATGAACTTAGCAGATTGAG[C,T]CACTTTTTGATTGGTTATGTTTGGT | 248,332 | 83 |
| 210. | ATTGAGCCCACTTTTTGATTGGTTA[T,G]GTTTGGTATTACCCATTTTATCTTC | 248,350 | 83 |
| 211. | CAACATGAGCAACTAGTATGCGCA[G,A]TCACTAACAATGAAATTAAGGAAGT | 248,404 | 83 |
| 212. | GATGTTGTTCTTATTGTGAAGGAT[A,G]CTTCACAATATATATCTATGCCATG | 248,543 | 83 |
| 213. | ACAAACTTTTATTACTTGAATCTC[A,T]AAAAAGAATAATCTTATTTTAATTT | 248,602 | 83 |
| 214. | TATTACTTGAATCTCAAAAAAGAA[T,G]AATCTTATTTTAATTTTTGATCCAT | 248,611 | 83 |
| 215. | TAATACAACTTAATCATTGCAAAT[T,G]TTTTTACAAACAAACTACTTATCAT | 248,670 | 83 |
| 216. | ATCATGTCTTCCTTAATCCATCCT[G,A]TGCAAGGTGCCTTTTTTCCTACATA | 248,715 | 83 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 217. | ATATGTTTTGATTACCCAAAAGAT[T,C]ATGCATTTCCTTGATGCATGCACCTG | 248,777 | 83 |
| 218. | CATTTTGGCTTTCAACTTGGATTC[A,G]TAAAGTGGGTACAACTCCGTGTCAA | 248,913 | 83 |
| 219. | ACTTGGATTCATAAAGTGGGTACA[A,G]CTCCGTGTCAACTTTATTAATAAAT | 248,927 | 83 |
| 220. | TATAAATGATAAGCTATCTTCTT[G,A]GTATCAAACTACTATGGGCTTAACA | 248,969 | 83 |
| 221. | TCGGCTAGAAATGATCCAACTCTT[G,A]CTCATATTTTTTCTAATTTATATTG | 249,120 | 83 |
| 222. | CAATGGAAGACTCTTTCATTTGCA[T,C]GAAGAGCAATCTTAATGCAATCGAT | 249,387 | 83 |
| 223. | CATTTGCATGAAGAGCAATCTTAA[T,C]GCAATCGATCTTAACTTCTATCCCC | 249,403 | 83 |
| 224. | TTCATTTCCCTTCCTCCATTCTAC[A,G]TATATTAGAGAAGTACTTTTGTGCC | 249,472 | 83 |
| 225. | TCTATTGATTGGCATGGTCTACAC[G,A]TTCTTGCTCAGAGTATTGTTTGTGC | 249,537 | 83 |
| 226. | ATGGTCTACACGTTCTTGCTCAGA[G,A]TATTGTTTGTGCCTCCAAATCAAAA | 249,550 | 83 |
| 227. | AATATTCAGGTCGATATCAGGAGG[T,G]TCAGCTTGTTAAGTTTATTACACCT | 249,903 | 83 |
| 228. | TCAGTCTCTTTGCATAATGTTTCA[G,T]CTACCATATCCTCTTCTACCTCATC | 250,081 | 83 |
| 229. | ATACTATTTGGAGACTTTCGATTT[G,C]TATGAATGTCAAGACTTTTGTTGG | 250,148 | 83 |
| 230. | AGACTTTCGATTTGTATGAATGTC[A,C]AGACTTTTGTTGGAAACCGATTTG | 250,159 | 83 |
| 231. | CTTTTTGTTGGAAACCGATTTGGT[T,C]GAAGCTCCCGACCAAAGAATATCTA | 250,187 | 83 |
| 232. | TATATCATGACAGGAAGGAGGATT[T,G]ACAGTATATTTTTCTCAGTTGCAAG | 250,280 | 83 |
| 233. | ATATTTTTCTCAGTTGCAAGCTTT[C,T]ACTCCTTTGTTGGACACATGTAGTC | 250,310 | 83 |
| 234. | GTAGGAATTTGACAACTTACATCG[G,A]ATACTTGCTCAAGTTTCACCTCTTC | 250,576 | 83 |
| 235. | TAAGTTTGCTAACTCTCTTTGGGA[C,T]CTTTGTGTGCCTCTCAAATTAAGTT | 250,717 | 83 |
| 236. | CTTCTTCGGAAGAAGACTGGAAAA[A,G]ATCTAGGTGGTTGTGTGCTTTGTGG | 250,816 | 83 |
| 237. | GGAAAAAATCTAGGTGGTTGTGTG[C,T]TTTGTGGCCATGGAGAAGAGTCAGT | 250,834 | 83 |
| 238. | CTCAACTTGTTTTTtCTTCTCATC[C,T]ATCTAGAAAGCTGTTTGTTCCTTAC | 250,896 | 83 |
| 239. | CATCTAGAAAGCTGTTTGTTCCTT[A,G]CTTGGGATACTACACCGACAGTCTT | 250,920 | 83 |
| 240. | ACAGTCTTCCTTTGAGGATCAATG[T,C]CTTTCATGGAGAAGAAGGACCTTCT | 250,962 | 83 |
| 241. | AAGAAGGACCTTCTCAAAATATTT[A,G]CAACCAATTATTTTGATGCTATACT | 250,998 | 83 |
| 242. | CCAAGGATGCTTGCTGATGACTGA[T,A]ATGGTGAACAATGCAAACAAATGAG | 251,223 | 83 |
| 243. | GAAGGGGCAAATGGATATGACATT[A,C]CCACTTATGCAGATGGGTTCTCTAA | 251,313 | 83 |
| 244. | AGATGAAAAATTCAGAATAGCCTT[A,C]CAGGTTTACGTGACTTCAGTAAACT | 251,538 | 83 |
| 245. | TTCAGTAAACTAAAAACAGTTTGC[A,G]GCTATCCAAAAAGCGAACCAAATGG | 251,577 | 83 |
| 246. | GATGAGAACAACATCTTTAGTTTC[T,C]CTATTCAATAGTTTCGATCCCAAGG | 251,627 | 83 |
| 247. | ATCCTCAGTGATTGCAGACCAGCT[A,T]GTGAGCATTTGAATAATTCTTAGAA | 251,725 | 83 |
| 248. | TTGAATAATTCTTAGAATCAGGGT[C,T]TTTGCTGTTAGAGCTTCAAACTTGA | 251,758 | 83 |
| 249. | TATCTTCAGCCGAAGATGAGGTAT[A,C]CAAAATACCTAGCTTTTGAGTGATT | 251,919 | 83 |
| 250. | ATAGATGCAGATGGTGAAAAGATG[G,C]CTTATGGATTCTGGATGTAAACAAC | 251,989 | 83 |
| 251. | AGATGGCTTATGGATTCTGGATGT[A,T]AACAACACATTGGACAAACATGAGA | 252,008 | 83 |
| 252. | TCTGTAGTAAGGATTTTGTTGTTT[T,A]GCAGCAACCAAGTAAAAATTTTAAT | 252,086 | 83 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 253. | TTTTCTTTGCAAAGATAGACCTGA[T,G]ACTGCCGTCACTGAAGAATTGATAA | 252,161 | 83 |
| 254. | TGCAAAGATAGACCTGATACTGCC[G,A]TCACTGAAGAATTGATAATATTTTC | 252,168 | 83 |
| 255. | GATACTGCCGTCACTGAAGAATTG[A,T]TAATATTTTCTAACAGAGAATTTTC | 252,183 | 83 |
| 256. | TAAAAGATTTCCTCCATGTTCAAA[G,T]ATATATCTTCCCTGAAAGTCATCTC | 252,310 | 83 |
| 257. | GAAAAGATGAAAAGAATTGAAAA[A,T]TTGGATTTCAGTGGCATAATTCCAA | 252,408 | 83 |
| 258. | GGATTTCAGTGGCATAATTCCAAG[C,T]CATTGGTCATCCAAAATGAGATATT | 252,435 | 83 |
| 259. | CATTGCCCAGATTAAAATAAATGC[T,C]CATTGGTCATCCAAAATGAGATATT | 252,490 | 83 |
| 260. | AGCCCTTCCTTTTGTTCTGTTTAG[C,G]AGTCTGTTATGATAGTGCGGCTGTG | 252,575 | 83 |
| 261. | GGAAGACATCTAATATATTGGTAT[C,A]CTACTGAGAACGTGATTAATAAGAG | 252,851 | 83 |
| 262. | AAGTGGAAGTCCCAGGTAAGTAGT[G,A]GGCAATGTTGATAGCTTACAACCAA | 253,007 | 83 |
| 263. | GTGGAAGTCCCAGGTAAGTAGTGG[G,A]CAATGTTGATAGCTTACAACCAATA | 253,009 | 83 |
| 264. | TTGTATCCCAAAAGTGCTGGTAAA[A,G]TGATATTGGAAATCCCTCTGGTCCT | 253,454 | 83 |
| 265. | ATCCCTCTGGTCCTGGTGATTTAT[A,C]CTTGGCCATACTGAAAAGGGCGTTT | 253,490 | 83 |
| 266. | GGCATAGCAAGCTGAAAAAATTTG[G,A]CAACAGAAGTTTAATTTATTTTATA | 261,788 | 83 |
| 267. | CAGAAGTTTAATTTATTTTATAAT[C,T]ATGGATTTGTAGTTATTCATAAATG | 261,816 | 83 |
| 268. | AATCATGGATTTGTAGTTATTCAT[A,G]AATGTTGAGATTCGGGTTAGTACTT | 261,837 | 83 |
| 269. | GTTATTCATAAATGTTGAGATTCG[G,A]GTTAGTACTTACTTTTGGATTTAGA | 261,852 | 83 |
| 270. | ATGTTGAGATTCGGGTTAGTACTT[A,G]CTTTTGGATTTAGATGCTCTGAACC | 261,863 | 83 |
| 271. | CCCATATTGGTTCGATTATTTGAT[A,G]AATAATAGAATTGAATCTTTTTATT | 261,911 | 83 |
| 272. | AATATGGGTTCAGAGCATCTAAAT[C,T]CAAAAGTAAGTACTAACCCGAATCT | 261,919 | 83 |
| 273. | AATTTGGTGTAGATTGCCGATGAT[C,T]CTCCCTTGGTCCTCTATCCAAGCGA | 262,136 | 83 |
| 274. | TGAAAAATTTGGTATTTTGTCC[G,C]CATATTTTAACCAATTTGCTCTGGA | 262,221 | 83 |
| 275. | AACTTGCTCTTTTCTATTACTTTTC[C,T]TTCTCTCTTTGGCTCTTCTCCTCGT | 262,304 | 83 |
| 276. | CTCCCATCTTTTCTATTACTTTTC[C,T]GCCTTTACTTTGTGGATCAACACTT | 262,735 | 83 |
| 277. | TGAGCAACCTTCTGTAAATACCTT[A,G]GACTTCAATAAAAACCGGATGGCAG | 262,794 | 83 |
| 278. | ATAAAAACCGGATGGCAGAATTCT[A,G,C]CAGCCTCCCTTATCCTCAAACAAAa | 262,826 | 83 |
| 279. | AAAAACCGGATGGCAGAATTCTAC[A,T]GCCTCCCTTATCCTCAAACAAAaAA | 262,828 | 83 |
| 280. | TCTACAGCCTCCCTTATCCTCAAA[C,A]AAAaAAAAAAAatGAAGAAAGGCTAG | 262,847 | 83 |
| 281. | ACTGGGATAGCTCAGCTTtTTTAT[T,C]TTTtACATCACCATTCTTTCCCTCT | 263,020 | 83 |
| 282. | AGCTTtTTTATTTTtACATCACC[A,C]TTCTTTCCCTCTGTTAGATGGCTTC | 263,033 | 83 |
| 283. | CTCACTTTGCAGTAGTCAAAATAA[T,A]TTTTGATAGCTTAGTTAAGCAAGGA | 263,086 | 83 |
| 284. | CTATCAGAATAAATAAAACTTCTA[C,T]TCCTATTGCAGGTTGGTACTTGGGC | 263,195 | 83 |
| 285. | AATCCAACAGATTGACTAGCTGGC[C,T]ATGCTTGTGACTTCAATCCTTTGGA | 263,429 | 83 |
| 286. | TCTTTCACTCTATATGCCAAAGAT[A,C]TTGCCTTTTTAATGACTATATTCAT | 263,737 | 83 |
| 287. | CCACTCTTTATTGCAGATGGGCTG[C,T]GTGTTATGGAATATATATTGCAGAT | 263,820 | 83 |
| 288. | TATTACATGGTCCTAATTTTACCT[A,T]ATTTATGTTCGTTATACTTTCAGCA | 264,095 | 83 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 289. | TCCGCATTATACCAAATCAGCTTG[A,C]CAATCGTTCGACATTTATTCTTATT | 264,218 | 83 |
| 290. | CGTTCGACATTTATTCTTATTGCG[C,G]TGTTGAGCAACTTGTCTCATATTTA | 264,247 | 83 |
| 291. | TTATTCTTATTGCGCTGTTGAGCA[A,G]CTTGTCTCATATTTATCTTGCTGCA | 264,257 | 83 |
| 292. | TAATTTTTAGCTTATCTAGTGTCA[T,G]CATTCTACGTTTACATGTATGCACT | 265,482 | 83 |
| 293. | TCTCTCTCTCTGTATGTGTGTGTG[C,T]GCGCGTGCGCGCGCGCATGCAATCC | 265,826 | 83 |
| 294. | AGATGGACCATGGAGACTGTTCCC[T,A]CTCTTTCCCCTATTCATGTTCGATA | 265,968 | 83 |
| 295. | ATAGTTATTTATCTGTCATCCCAT[T,C]TGGTGGTTCTGTCAGATTAAACACC | 266,057 | 83 |
| 296. | GATTCTGTCTATAAAGCATGGATA[C,T]GGATGTGACACGATACAGATGTGCC | 266,188 | 83 |
| 297. | GTGACACGATACAGATGTGCCGAT[G,A]TGACAAGTTTGGAGAAGTATGTTAC | 266,217 | 83 |
| 298. | TATGTTTTAAAGAGTGATAGCACG[T,C]ATTATTTGATAAACATAGAGTGATA | 266,461 | 83 |
| 299. | ATTTGAAGTTGAGCTTGACCAGAC[C,T]CAGGCTTGATTAACGTCAGTTAATC | 266,811 | 83 |
| 300. | TTGCTTTTGAGCTCTGACTGATAT[T,G]CTTATTTCTATTTGAAGGGTTTCAT | 267,210 | 83 |
| 301. | AGCTCTGACTAGGTGCAAACAAAA[T,G]TTATTTATTCCAAATGCCTGTGCTT | 267,441 | 83 |
| 302. | TACACATAGTAGTCTGCCTAAAAG[T,C]ATCATGGGCTTTGCCAGTATAATGG | 267,784 | 83 |
| 303. | CATGTGCTAGTATATTAATGAAGA[G,A]CAGATGGTCTCATGCAGGTGGCGAA | 268,130 | 83 |
| 304. | CTGAACCGGGCCTCCAGTGGCTTG[G,T]CAAAAGGAGATAAACATTTGGCTAT | 268,605 | 83 |
| 305. | GAACCGGGCCTCCAGTGGCTTGGC[A,C]AAAGGAGATAAACATTTGGCTATGA | 268,607 | 83 |
| 306. | CAACAAAAATAAAaTAAAaAAaT[A,C]AAATAAAATAAGATCCTTGAATTCA | 268,934 | 83 |
| 307. | AAAATAAAaTAAAaAAaTAAAAT[A,C]AAATAAGATCCTTGAATTCAGCTGC | 268,939 | 83 |
| 308. | TGCTGTCAGAGTCCATTCTACTCA[A,T]CAAGGAAATTACAGTAGATGAATCT | 269,103 | 83 |
| 309. | ATTCTACTCAACAAGGAAATTACA[G,A]TAGATGAATCTCCTCTCCATATTGC | 269,117 | 83 |
| 310. | CTCCATATTGCAGATGCCTTTCAA[A,G]CCCGTGTGACAATCATAATCCCTTT | 269,156 | 83 |
| 311. | AGATGCCTTTCAAACCCGTGTGAC[A,C]ATCATAATCCCTTTCCAAGCAACAT | 269,167 | 83 |
| 312. | CCGGCCACCACTGTAACAGCTCCA[C,T]CCATATTTCTAATCATATAAATTAG | 269,258 | 83 |
| 313. | CTAAGAGTTAAGTCATCTATAATG[G,T]GGGATTTGGTGTAATTGAAGGAGGA | 269,359 | 83 |
| 314. | GGAAAATGCAAGAGTGCATAAAAA[C,T]GTCATAAAGATGATAATTGAGGTGG | 269,733 | 83 |
| 315. | AAGATGATAATTGAGGTGGAAAtT[T,C]TTTTGTAGAGAGGTTGATGCTGTTG | 269,764 | 83 |
| 316. | ACTCTTTGGTTACGTGGCCTTCTA[A,C]AAGGCTATCGAAAGATGTGTCTCGA | 270,299 | 83 |
| 317. | TCATTTTCTGGTCAGGCTGAAATG[T,C]CAATGCCCTCAGTTGTTTCTTCTTT | 270,358 | 83 |
| 318. | AAGCTAAGCGCCATATGTTTCCTT[C,T]CTGGATGAACAAAAGTACTGGAAAA | 272,395 | 83 |
| 319. | CATCTTGCTTCGGCTTCCGGCTCA[T,A]TTCTGAATACTGCCCCCCCATCAGC | 273,088 | 83 |
| 320. | GCAAAATCTCCTGCCACAGATTAG[T,A]TGAAGAATCTGCTAGGGCACTACTA | 273,139 | 83 |
| 321. | TCTATCAAAACTGCTTACCCCATC[A,G]AGCTTCTCAGTTGCAACTAACAAGC | 273,602 | 83 |
| 322. | TTCAAGATACAAGGATGGACAAGA[T,G]TATTCTGAAGCTAACTAAATGATCA | 273,906 | 83 |
| 323. | AAACTTAGCCTCTTATCATTATAT[G,C]AAATGCCAAACTTAGCCTCGCCGTT | 274,316 | 83 |
| 324. | GATTCTCTAATGGAATGATATGCT[T,A]CTCTATTTCGACTAGTCAACTCACC | 274,376 | 83 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 325. | AAAAaCAAGTACAATTACCAGTAC[T,C]TAATCAATTCAAGAGTACATAGCAT | 274,586 | 83 |
| 326. | ACAGTAGTTAGAAaTTAAAAAAGT[G,A]CAATTCTGGATGCTAGGTCATTTCT | 274,696 | 83 |
| 327. | AAAGTGCAATTCTGGATGCTAGGT[C,T]ATTTCTGATGTTTGATGATTTATAA | 274,715 | 83 |
| 328. | GTGCATATATAAATTTTTAAACAA[A,C]ACTTAGCGAAAATGAAATTAAGAAG | 274,981 | 83 |
| 329. | ACCTTATCAACCTTAACTACCTAC[A,G]TTTAAAATCCTTATAAGAGCAGGAT | 275,070 | 83 |
| 330. | TTTAAGCCCCATACTAATTTCTCT[G,A]TGTCGTTTATAAACCCATAACCTGA | 275,155 | 83 |
| 331. | TTGAGGTTTATCCTGTGTCACTTC[G,A]TATAGGAGATTATGTTATGCACAAA | 275,692 | 83 |
| 332. | AGCTTAATCACTATACCTCAAGGC[A,G]GATTTATAACAAATGGATTATCAGA | 275,815 | 83 |
| 333. | AACACCAAAAATAAACCATGGGAA[G,A]AAGGCAGCAGCATCTACAGCCTCAA | 275,916 | 83 |
| 334. | TTATGCATATCTAGGTCTTTGATT[A,G]TACAATAACCTATAAAGTATCATAG | 276,097 | 83 |
| 335. | TATAAAGTATCATAGAAGTCCCAA[C,A]ATCATGAATTGAATTGTCTACGAGT | 276,132 | 83 |
| 336. | CCCAGTTTTTGTGCTAACTGCAAA[A,G]AAaGGAAATGCTCCCTGATCCTCCA | 276,667 | 83 |
| 337. | ATAGCTAGACATTTGGCGATCTAT[G,A]GTCGGACTTGAAATCTTATTTTGAC | 276,971 | 83 |
| 338. | GAACAGTCTTATCGGCTGTTAAAG[T,G]GGCATGATGCTGTGCTCCTAACAAT | 277,896 | 83 |
| 339. | GTACTCACACATTTAAAGAGAAGA[T,C]AAGATGGGGAAATATGAGAGGAAGT | 278,554 | 83 |
| 340. | GAGAGATAAGAGAGATAGGGTGGA[C,G]AAGAGTAGAGATACAAAGCCACTTG | 278,613 | 83 |
| 341. | AAAAAaGAAGAATAAAAGGGAGAC[G,A]AGAGAGGGATAGGAGGTGAGAGAGA | 278,666 | 83 |
| 342. | ACCCCTATTTCGAATTGGAGTTCA[A,G]AGGTCCTCCTCCGGCCTCAGCCGCC | 278,867 | 83 |
| 343. | TCCTCCGGCCTCAGCCGCCCTCCG[C,T]TCCCTTGACGCTGGCTCGCCGGTTG | 278,898 | 83 |
| 344. | CATCTGAAGGCCTCCGATGATCCA[A,G]TGAGGTCTCCCCCGCTTTTCTTCCC | 278,976 | 83 |
| 345. | CGATGATCCAATGAGGTCTCCCCC[G,T]CTTTTCTTCCCTCCCTCCACCCTTA | 278,990 | 83 |
| 346. | CTTCCCTCCCTCCACCCTTAGCAA[G,C]CTCAGAAAGAGCTCCGACAGCCACC | 279,020 | 83 |
| 347. | TCGATATGGTTCGACATGGCCTGC[G,A]TCGTCCGATTTGGGATAGTTCAGCG | 279,185 | 83 |
| 348. | ATGATATCAAACATGGTGGACTCT[G,A]AAGTATTTCAAGGAAAAGAAAAATA | 279,747 | 83 |
| 349. | AGTATTTCAAGGAAAAGAAAAATA[T,A]AGAGAAATTCACCAAATCTTGAATG | 279,773 | 83 |
| 350. | TTCAAATAGTTTTCAAGCAAGGTA[T,A]GACACTAGCAAGAAGAATCTCGCAA | 280,334 | 83 |
| 351. | CGGGTCTTGAATTAAGCTTTTAAT[C,G]AACTGCTTAAATGCCCAAAATGGAT | 280,447 | 83 |
| 352. | CTCAACGCCAAACCACTGCAGCAG[C,T]TGTGCCGAAGTAGTTTGTCCAGGTTG | 280,840 | 83 |
| 353. | AGTAAAGATATAACTGTTAAAAGA[C,T]CAGACAAGTTTCACGGTAATTCTAT | 281,259 | 87 |
| 354. | GTTTCCGATGGGAGCGAGAAAGA[G,A]GCCAGGGATTGGGAAGCTACAAGAG | 282,139 | 87 |
| 355. | GGATTGGGAAGCTACAAGAGCGAG[T,C]TACCGGAGTGGGAGGAAACCTTGG | 282,169 | 87 |
| 356. | GATTGGGAAGCTACAAGAGCGAGT[T,G]ACCGGAGTGGGGAGGAAACCTTGGG | 282,170 | 87 |
| 357. | TACTATATTTAGTTGGAGGTGATC[G,A]TATATAGAAATATGATAAAATTTAT | 282,989 | 87 |
| 358. | GATAAAATTTATAAATATATTTTT[C,T]AATATAAAATAATTTTAAAAAAaTT | 283,027 | 87 |
| 359. | TTAAAAAAaTTATACAGATATCTC[C,T]TTAAGTTTATTTCAATTTCATTTAT | 283,066 | 87 |
| 360. | TAAATTAAATCGTCTCAATTAGA[C,T]CTTCCAAATTATCGAAGTGTATCGA | 283,123 | 87 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 361. | TTATCGAAGTGTATCGATGTGCTC[C,T]TTCCGTTCATCTTCGTTAACCAAAT | 283,156 | 87 |
| 362. | ATTTTTTtAAAATAATAAAAATAT[T,C]CTTGATTTCAATTCTCAGTCGAGCA | 283,235 | 87 |
| 363. | CGAGCATTAGCCAAAGCGTCAAAA[G,A]GTAAAATCACATGCCTCACGTGAGC | 283,279 | 87 |
| 364. | CAAAAGGTAAAATCACATGCCTCA[C,T]GTGAGCCATTATTTTGGATGCCCTA | 283,298 | 87 |
| 365. | GAGAGAGATCTTCGATCAAGCTAG[C,T]CGTGGTAGAGAAGGAGTCGCCATGT | 283,390 | 87 |
| 366. | AGATCTTCGATCAAGCTAGCCGTG[G,A]TAGAGAAGGAGTCGCCATGTACGCC | 283,395 | 87 |
| 367. | CCGCAGGTGGAGAAGAAAAAATTC[A,G]TGAAAGAAAAaGAAGGTTACCGATA | 283,443 | 87 |
| 368. | TGAAAGAAAAaGAAGGTTACCGAT[A,G]GAGAAAAAAGCAATGAAGGGTTTCC | 283,468 | 87 |
| 369. | GTGGAACCAGATTGCTACTGAGAA[C,T]CTTTGGGACCACCGCAAATCCTGGT | 283,569 | 87 |
| 370. | ACCAGATTGCTACTGAGAACCTTT[G,A]GGACCACCGCAAATCCTGGTCGGCA | 283,574 | 87 |
| 371. | CTTTGGGACCACCGCAAATCCTGG[T,C]CGGCATTTCTTTAGATGCAGAATGT | 283,594 | 87 |
| 372. | TGTTTAACTTCGAATTGTTTGTCA[A,G]GTAAATGGGGGCTCTGGTTCTTCC | 283,696 | 87 |
| 373. | CTGGATTGTTATGCTTTTTTATAT[A,T]ATCGATTTTCTATTTTAAATATACT | 283,883 | 87 |
| 374. | AATTCTTTATGAAATGAAAAAAAa[T,A]TTCTCTAGTTGTTAGCAATGATGGT | 284,020 | 87 |
| 375. | AGTGCTACATTGTTAATGGTACAG[T,C]ATACTTATAAGTTTCGATGAACACC | 284,077 | 87 |
| 376. | ATTGTTAATGGTACAGTATACTTA[T,C]AAGTTTCCGATGAACACCCCTGATAT | 284,085 | 87 |
| 377. | TATACTTATAAGTTTCGATGAACA[C,T]CCCTGATATTTTATTGCTATTACGC | 284,101 | 87 |
| 378. | CCTATAAGAATTTTTTTtGTCACA[C,T]GCATCAAAATATCACAACTTTTAAT | 284,245 | 87 |
| 379. | TACAAAAAATATAAAAAATTTGAC[T,C]GACAAATCACAATGTATCAGTGCAT | 284,302 | 87 |
| 380. | ACATACAAAATACAATGAAGTCCC[A,G]AATATATCTAAAATGGCCTTGATAC | 284,392 | 87 |
| 381. | TCTGAGACAAATAACCTACTGCTG[A,G]CTGGAAGGGAGCTGGTTGGGAGAAA | 284,514 | 87 |
| 382. | GACAAATAACCTACTGCTGACTGG[A,G]AGGGAGCTGGTTGGGACAAAGAATG | 284,519 | 87 |
| 383. | TAGTAGCTTCTGGCTGGGAGGACA[G,A]ATGCTGGAGGGAGCTGGCTAGGAG | 284,583 | 87 |
| 384. | GCTGTAAGGACAGAGGTTGGGAGG[A,G]AACTGGTTGGGAGAATGTACCCACT | 284,646 | 87 |
| 385. | GGACAGAGGTTGGGAGGAAACTGG[T,G]TGGGAGAATGTACCCACTGAAGTTG | 284,653 | 87 |
| 386. | TTTGGTCTATAAAAAAaTACAAAA[T,A]GATAAGTAAATATTTATTAATTTTA | 284,728 | 87 |
| 387. | TAAATATTTATTAATTTTAATATT[A,G]AATATAAATGTACCAGTGATCTCTC | 284,759 | 87 |
| 388. | GCAAGCCCTGGAGTTATGGACCCA[T,C]TGTTGACAATTCTTGCACCTTAAGG | 284,893 | 87 |
| 389. | AAGCCCTGGAGTTATGGACCCATT[G,A]TTGACAATTCTTGCACCTTAAGGAT | 284,895 | 87 |
| 390. | GCCTATGTTGCTTTAGTGTACCAT[G,A]TACTAACAAAATATTCTGCTTCCTT | 285,123 | 87 |
| 391. | ATACATAATAGCTATTACAGCATG[G,A]CAGCATGGGATGCCAGTTAAATCTT | 285,179 | 87 |
| 392. | CAACAAATCTATCATTGTGATGCT[T,C]AATTTCAATTTTGTAGCCTCCTCCC | 285,265 | 87 |
| 393. | CCATGGCCTCTAACTTTTGCTTTTT[C,T]CAATTTCTTTTGAATCTTAGGACAT | 285,331 | 87 |
| 394. | CAATAATATACTTGTTGAATGACT[C,T]GCATATGTTGTTCAAAAGCATGCTA | 285,487 | 87 |
| 395. | AAAGCATGCTAGACTTCCTTCTAT[C,T]GCTGAAAGCATGCCTCGCCCATAGC | 285,526 | 87 |
| 396. | GCCCATAGCTCTGGTGGATGTTGT[C,T]GAAGCCACTGCCATGTTGTCTCATC | 285,567 | 87 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 397. | ATAACACTCTTGAAGGTCTCCACA[G,A]GACCCAATAAAAGAATTGAAAAAAa | 285,774 | 87 |
| 398. | TCCACAGGACCCAATAAAAGAATT[G,A]AAAAAAaTAAATTACGTATAAAATC | 285,792 | 87 |
| 399. | AAGAGAATTGAACAAGTTTTTTAA[T,C]AAGATAAATAAACCTTCTGTCTGTC | 285,851 | 87 |
| 400. | TAATAAGATAAATAAACCTTCTGT[C,T]TGTCAGACATAAAGATCCATCCATG | 285,872 | 87 |
| 401. | TCTCTACAACAGCCCATGCAACAG[A,G]AAAAATATTTTCATTTCTATCCTTC | 285,983 | 87 |
| 402. | CCAAAAGAGCCCCTTCAAGTGGCAA[C,T]TGTCCAAACCAATGATAGATCTGCA | 286,057 | 87 |
| 403. | TAGATCTGCAACCTTTGATAAAGC[C,T]CTGCTTGTATGCTGCAAGACAACAG | 286,097 | 87 |
| 404. | AACAGTATAACCTTCTAAAAATGG[G,A]CTGGCTACTCTCATCGACCTACTAA | 286,142 | 87 |
| 405. | CTTCTAAAAATGGGCTGGCTACTC[T,C]CATCGACCTACTAACATCCAACAAC | 286,153 | 87 |
| 406. | CCCTGTGGCTGTCCTAAATAATCT[C,T]CAATGCTCTACTTTGGCCCTATAA | 286,267 | 87 |
| 407. | TTATTTGATAGGTAAGCTCGCTCT[G,A]TACAGAAAAAGTATGAATCTTCCAC | 286,492 | 87 |
| 408. | CCTCCTATATGCTATAAAGCCACA[G,A]CACTTTCTTAAACTGTGTGACATTC | 286,609 | 87 |
| 409. | ATTGAATTCAGGATATTCAGAACC[T,C]CGAATACCAGCATCTGAATCACTAT | 286,712 | 87 |
| 410. | TAGGCTGCTCCTCTCCAAAAAAAT[C,T]AACTCCCTCATGAGGTAGAGAATGA | 286,816 | 87 |
| 411. | GGCTGCTCCTCTCCAAAAAAATCA[A,G]CTCCCTCATGAGGTAGAGAATGATG | 286,818 | 87 |
| 412. | CAGGCAACCGTAGGATTTGAAGTG[A,G]CAGCTTCAATCCCTTTCAATTTCTT | 286,980 | 87 |
| 413. | TTTTCATTACCAATCTCTTTACCC[A,G]AGTTCTTGGTGTTGATGCATTGTAT | 287,059 | 87 |
| 414. | ATACACACCAACAAGCTTTGTTTG[T,C]CTGTTTCAGATAAAGGAACATCACC | 287,143 | 87 |
| 415. | CACCAGCATTTGCTTGGTGCTCAA[C,T]ATATACCTCAACCATATCAGCACCT | 287,189 | 87 |
| 416. | GCATGACATCTTAATTTCCTCAAG[C,T]CATTTTGTAATGTCTGTCATGGCAT | 287,269 | 87 |
| 417. | TCAAGCCATTTTGTAATGTCTGTC[A,C]TGGCATTAGGTAATAAAAATGGTTA | 287,288 | 87 |
| 418. | CTGTCATGGCATTAGGTAATAAAA[A,G]TGGTTACAATTTGTGTATCCTAACT | 287,307 | 87 |
| 419. | ATTAGGTAATAAAAATGGTTACAA[T,A]TTGTGTATCCTAACTAGCTCATCAT | 287,317 | 87 |
| 420. | TTAGATGGTATTTAAAAGATCTAC[T,C]ATAATGAATTTGTACAGTAAATAAG | 287,447 | 87 |
| 421. | AAGTTAGAGTCTATCTCTGCACAA[T,CT]GAATAAGAGACATAGAATACTAAAA | 287,494 | 87 |
| 422. | AGAAGAGAATCTGATCTTTTTCTT[A,G]ATAATTGGGTTAATCTGATATAACA | 287,626 | 87 |
| 423. | ACATGTACAAAAGATAAAGGACAC[T,A]AAAAAATACTAAGTTAATCAGAGTC | 287,685 | 87 |
| 424. | GTGGATCCTATCTGTCATGCTCAC[G,A]TATATCAAAAATAGGACCACAAAAT | 287,840 | 87 |
| 425. | TGGATCCTATCTGTCATGCTCACG[T,C]ATATCAAAAATAGGACCACAAAATA | 287,841 | 87 |
| 426. | CAAAATATATGAGGACAAAGGGAC[C,A]ACAAAAATCAAAGAAAAAAaTCCTA | 287,884 | 87 |
| 427. | GTATCGGTTTACAACCATAAAATC[C,T]TAAAACTATCGGTTGGCCACTAAAG | 287,937 | 87 |
| 428. | AGATGTATTATCGGCAAAAGAAGA[T,C]ATAAGGCTCATCCACAGATAAAAAT | 288,049 | 87 |
| 429. | CACAGATAAAAATAAGGTATTCAA[G,A]AGGCTATCACGCTCGTGCACAAGGG | 288,086 | 87 |
| 430. | TAAAAATAAGGTATTCAAGAGGCT[A,G]TCACGCTCGTGCACAAGGGAGGAGA | 288,092 | 87 |
| 431. | GGATAGCATTATCATTTTCAATTA[A,G]TTTTTATATAATGAATATAATCACA | 288,461 | 87 |
| 432. | ATGAATATAATCACATAACTCTTT[G,A]CATAATGCTATCTTCATCTTAATTT | 288,496 | 87 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 433. | AAAAGCTCTTTATTGAATAAATTT[G,A]GATAGACATTAAAACAAATTTAATA | 288,552 | 87 |
| 434. | GATAGACATTAAAACAAATTTAAT[A,G]ATTACATATGTAGCTTTATTGAAGA | 288,577 | 87 |
| 435. | TGTAGCTTTATTGAAGATATTTCT[G,A]TCAGGTATAGATTATCATCATTTAG | 288,610 | 87 |
| 436. | AATTTTTTtATCATTTTTTtATTT[C,T]ATTTTTTATACTAAATATTATAATT | 288,726 | 87 |
| 437. | TGATCACATTTATCAACTTTAAAA[A,C]GTGATTATTTTAGGTATCAAAAATT | 288,915 | 87 |
| 438. | ATTTAAGGATTGAAAGACTTCACC[T,A]TTATTTtGTTTTTGATCAAAGCTTG | 289,120 | 87 |
| 439. | TTTGACTGATTGAATTGGAAACCG[G,A]TTATCTATCCAAAATAATATGAAAA | 289,258 | 87 |
| 440. | AAAAATAATCAAAACTTGGTCAAA[T,C]AGGATGAATCGGATGAACCAATCAG | 289,314 | 87 |
| 441. | GTCCTAAATCTCTCCCTCTCTCCT[T,C]CATCACTGGAATCTAGTGCCTCCCA | 289,530 | 87 |
| 442. | ACTGGAATCTAGTGCCTCCCAACT[T,C]TGCCCTCGAGAGTTTCTCCAAACCT | 289,559 | 87 |
| 443. | AGCTTCTCTCACACCTAGTCTCTA[G,A]GGTTTTGTGGTGCTCAAGGCCTTTC | 289,610 | 87 |
| 444. | CTAGGGTTTTGTGGTGCTCAAGGC[C,T]TTTGGTGGTGGGGAAGATGGAGCTG | 289,631 | 87 |
| 445. | CACTCATGGTACTCACCTCAAGGT[T,C]ATCTATATTGGGTCCTTTCTCATTT | 289,922 | 87 |
| 446. | CGACAACACCACTACTATCCACCA[C,T]TTCATCGCTAGCCCTCCCTCCTTCG | 289,988 | 87 |
| 447. | TCCTTCGTCCCTTCCACCCTACAA[G,T]GACTAAACAAGCCTGCTCTATTGAC | 290,031 | 87 |
| 448. | AGGTGGATAGTGGGGAGCATAAG[A,G]AGCACTTGAGAGTAATAAAGGAGTA | 290,198 | 87 |
| 449. | GATAGTGGGGAGCATAAGAAGCA[C,T]TTGAGAGTAATAAAGGAGTAAGGAG | 290,203 | 87 |
| 450. | TACTGCATGTGATAGTGGGGAGGG[A,G]CATGTGAGATATACAACGGCATTGG | 290,283 | 87 |
| 451. | CATTGGTGGATCAATCAAACTGAC[G,A]TGCACCAACCATGCGTGAAGAGTGA | 290,327 | 87 |
| 452. | GTGAAGAGTGAGGAAGGATGCTTT[T,C]CGAGCATGTGAGATGAGGGCAATTA | 290,366 | 87 |
| 453. | GAGGGCAATTAAATTGGCCAATCA[G,A]ATCGATTAGACTGGTCAACCCAAGA | 290,405 | 87 |
| 454. | TAACTTGATGGTTCACTATCTAAT[T,C]CGATTTTAAAAATATTACTTTTTTA | 290,461 | 87 |
| 455. | ATCTAATTCGATTTTAAAAATATT[A,G]CTTTTTTATTATCTTTTATCGCACT | 290,478 | 87 |
| 456. | TCAAAAATATAACAGGTATCATAT[T,A]ACAACTCCAATGAAAACAATGAAAG | 290,840 | 87 |
| 457. | ATTAATGCGCACATGAGAAGTTCA[C,T]GACTCACAAATCTCAGGAATGGTAG | 290,902 | 87 |
| 458. | AATATTATTTTGGTATCAATGCAA[T,C]AAATACAAATATACAATGAGGAGTC | 291,108 | 87 |
| 459. | ACCTTGAATGGTAGATATTAAATA[T,C]GGATAGGCCAAACAGTGGGGTCCAT | 291,394 | 87 |
| 460. | ACCACATGATGATCACTGGGGCCG[T,C]TAGTTCATTCGATCTTGATAGATCC | 291,719 | 87 |
| 461. | AGATCCGATCCGATCTGAATCAAT[T,C]AAATTTAAAAATTAAAAaTTAAAAA | 291,763 | 87 |
| 462. | GTGAATCAACACCCACTTAATTGA[A,C]ATTTCAAAAGAATCCCCATGCTACA | 292,995 | 87 |
| 463. | GAATCCCCATGCTACAATGGCTCA[A,T]GGATACAAAATCACCACCCGTTGAG | 293,029 | 87 |
| 464. | GTTCCAACATAAAACCCATCAAAC[G,A]ACGCTGAGTTACCCTCCAATTGCCG | 293,078 | 87 |
| 465. | AGATGCCTAATACTCATCACCTGT[A,G]ACAACCAAATTTTTGATGATATTTG | 293,152 | 87 |
| 466. | ATGAGAAGAATATTATGAGAATAG[G,A]TGCAAAAGGCTTTTCACATGGAATC | 293,337 | 87 |
| 467. | TCACATGGAATCTGGAGAATACTT[C,T]TATCAGGAAGATGTGAAAATAGACC | 293,375 | 87 |
| 468. | AAAACAAAATGCCACAATTTTGGT[A,G]TCATATACTGAGATTATATGCTTTC | 293,440 | 87 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 469. | TGAATTGACTGACGTAGAAAACA[T,A]AGTATAAGTGGGTGCAAAGGTGGCT | 293,562 | 87 |
| 470. | AGTATAAGTGGGTGCAAAGGTGGC[T,A]ATCTTGGTGCCTTAGGAAGTCTTTT | 293,587 | 87 |
| 471. | AGTGGGTGCAAAGGTGGCTATCTT[G,A]GTGCCTTAGGAAGTCTTTTGCTCAA | 293,593 | 87 |
| 472. | GCACAAAATAGGTGAACATCTTCA[T,C]ATCCCATGTTCCTTCTTCCTGTGTG | 293,792 | 87 |
| 473. | ACATGAGCATATGCTCACCAAAGG[C,G]CAACCTATTTTGTGTGGTTTCAT | 293,909 | 87 |
| 474. | GTTTCATGTGCATTCCATGCAAAA[G,T]TCTTGGACTTTACACAGGGATAGGC | 293,592 | 87 |
| 475. | TGTGCACTCCATGCAAAGTCTTG[G,A]ACTTTACACAGGGATAGGCATGCTT | 293,958 | 87 |
| 476. | TTGGTGCCATCTGCTTTTCCCTTC[G,A]TGTTCTTCATTAGCACAGGCACCCA | 294,075 | 87 |
| 477. | aAAAAAaGACTTAAAGCTCCACC[C,A]TATCACAAATCTCCTTAGCTTCAAC | 294,141 | 87 |
| 478. | ATTCTTTCTTGTTCTAGACCACTC[A,G]TCACTCTATTTCTTTGTTTTCATCA | 294,191 | 87 |
| 479. | TCTGGCTTTACTGAAGAAGTATCT[A,G]ATCCATACATATCACCATTTTGCAA | 296,049 | 87 |
| 480. | CATGGGAAGTGAGTATATGGTTTC[G,A]TTGAAAGCGAGAGGAGACTTTAAAG | 296,795 | 87 |
| 481. | AGCGAGAGGAGACTTTAAAGACAA[A,C]CCAATGAGATCATGACCTGTCAGCT | 296,825 | 87 |
| 482. | CCTCTGGGTAATAATGAAAACATC[A,G]GTCTCATTAATCTCATATGCTCCAT | 296,939 | 87 |
| 483. | CAAGTAAACTTTTCTACCTTCCAA[G,C]ACCTTCAACTGCGGAGGGAAAGGTG | 297,059 | 87 |
| 484. | TTGATTAAAACATACTCTTGTGGC[T,A]GAACACCTTCACCAGAGGCTCTATC | 297,123 | 87 |
| 485. | TGGAATTTGCAATATCACTGTCC[G,A]ATAGACCAAAGCTTCTCATTATCTC | 297,402 | 87 |
| 486. | TAGTAGAATCCTCCTCTGTGGAAG[A,G]AAACACAGGTGGATTTCCAAACTGC | 297,565 | 87 |
| 487. | TTGTCCCGAGCCTTGAACAGCTAC[C,A]GATAATCTACAAGAAATTTCAACCA | 298,363 | 87 |
| 488. | CAATAGCCTGACAAATACAATAAG[A,C]CCCAGCCATAATAATGCTTTCCCTC | 298,444 | 87 |
| 489. | ATCAAAAGATCAGGCTCGCAAACA[A,T]GCTTCGGATTGAGAAAACCAATAAA | 298,497 | 87 |
| 490. | ACCTATCACGGGTCAAGAAAA[C,G]GATTGGGTCACTTTGGTCTACTATT | 299,935 | 87 |
| 491. | CTACAACAAGTCAAGTCATGATGG[T,G]TTGAGCTGCAGTGAATTGGGTTTGG | 300,085 | 87 |
| 492. | CAAGTCATGATGGTTTGAGCTGCA[G,T]TGAATTGGGTTTGGTTTGGTTGCGT | 300,096 | 87 |
| 493. | ATTTAGCAACGTTTATGTTTTGAC[T,C]CAATCCGGCTCATCTTGACCATGCC | 300,272 | 87 |
| 494. | AACGTTTATGTTTTGACTCAATCC[G,A]GCTCATCTTGACCATGCCACCATGA | 300,279 | 87 |
| 495. | ACGTTTATGTTTGACTCAATCCG[G,A]CTCATCTTGACCATGCCACCATGAT | 300,280 | 87 |
| 496. | ttGCCCCCTTATATGAATCAGATC[A,T]GGCATCCGAGAATGTAATCAAGTTC | 300,382 | 87 |
| 497. | AAGAAAGAATAGTTCGGAATGAGA[A,G]TTTGTTCCAAAGTTATGTTGGTCCC | 300,451 | 87 |
| 498. | TTTTTAGCCCACTTGTGGTGTGGA[C,T]GAATGTTTCTTTTAGTAGTTGCATT | 300,509 | 87 |
| 499. | ATCTTGAGTATAAAAGGCTCTTAC[T,C]CTCTTTCCACCTTCGATCCGACTTC | 301,022 | 87 |
| 500. | AGCCAAACCTCCTTCGGTTTCCTC[C,T]TTTGATTTCCTTCTTCGATCCTCCT | 301,236 | 87 |
| 501. | AAGAAGCTGTACTCATCAGCACTC[G,A]ACTATCACTAAGGGAGCCCAAATCT | 301,307 | 87 |
| 502. | ACTCGACTATCACTAAGGGAGCCC[A,G]AATCTATGCCATTTTATTTCTTCTT | 301,327 | 87 |
| 503. | GTATTGCTTGGCACCTCGGTCACT[C,T]GAGATCTAGGATTTTTTTTtCTTA | 301,409 | 87 |
| 504. | GCACCTCGGTCACTCGAGATCTAG[G,A]ATTTTTTTTtCTTATTTTAATGGC | 301,419 | 87 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 505. | TTTATTTAGTAAATAGATTAAACA[G,A]ATTGAGTCAGATCAGTTAAACATGT | 302,448 | 87 |
| 506. | GTATTTATCCTCACCCACAGATTT[A,T]GTGCCGTCGAACTTTGGTAGCTGGC | 303,638 | 87 |
| 507. | ACAAACAAACCCATGGCATAGGGT[A,G]CACTTTGCTCTAAATCACCACTCAT | 304,506 | 87 |
| 508. | AATTAGGTATAATTTTCTCAATTG[G,A]TTATTGATTTGAAAATTTTTAAAGA | 314,020 | 87 |
| 509. | GTTGCCATCGATAGAGAATAATAT[T,C]TTAAATTAATTAGTAGTAAAAATTC | 314,126 | 87 |
| 510. | GAATAATATTTTAAATTAATTAGT[A,G]GTAAAAATTCAATCTCTCAATTTTT | 314,141 | 87 |
| 511. | ACTCAACTGATTGTTTTAAAAAAa[T,A]AATAAATTTTATTTAAAATCTAAAC | 316,153 | 87 |
| 512. | CCGGACCAGAAGATCAGCAAACTG[G,C]TCGGCATTGTACACGTTTCGTGTAT | 318,252 | 87 |
| 513. | TAACAATAATAGGAGAAAAATACA[T,A]GAAAACTGGTGCACACTGCAGGCAC | 318,855 | 87 |
| 514. | TGATGAGACGAGGGGACAATAAAT[G,C]CAGTCTACGAATGTATTAAATGGAG | 318,924 | 87 |
| 515. | GGAGAACTTGCTCTTATACCTTGG[A,T]ATTCGAGACTAGACCTTATTTTCCT | 318,970 | 87 |
| 516. | TATACCTTGGAATTCGAGACTAGA[C,T]CTTATTTTCCTTTGACCAATGTAGT | 318,984 | 87 |
| 517. | ATAGAAGATGAAAAATTGGTGGAT[A,G]TTAGAGAGTATTATTAGGCATAAAC | 319,035 | 87 |
| 518. | TAAATCAACCTTAGACATGAACCA[T,A]GGAGGATTCAAAGCAAAGTGTGTTC | 319,171 | 87 |
| 519. | TACCATACTTTAAATACAATGCGA[G,T]GAAAGAGATCGAGTAAAGTTAGCCC | 319,258 | 87 |
| 520. | TTTAAATACAATGCGAGGAAAGAG[A,G]TCGAGTAAAGTTAGCCCTATGAGAT | 319,266 | 87 |
| 521. | TGAACTGGATACAAGGTGGGAAG[A,G]AAAGGAGATGGGTTGATATAGAAAG | 320,075 | 87 |
| 522. | TGGGTTGATATAGAAAGGGGAAGT[G,T]AAAAGGATGGTGGGTAGATAAGGG | 320,108 | 87 |
| 523. | CTTGAATGCTGAATTTGAATGGTA[G,A]TAGCGTCATAGGCTCGCAAGTTTTA | 320,392 | 87 |
| 524. | TGAATGGTAGTAGCGTCATAGGCT[C,T]GCAAGTTTTAGCCTAGAAAGTGGAA | 320,407 | 87 |
| 525. | AGTTTTAGCCTAGAAAGTGGAACT[T,G]GATCAGAGTTTTTTtATTAGAAAAa | 320,435 | 87 |
| 526. | CAGTAACCATCATTGGACTACTTC[C,T]ATGAATTATGGCTTAGGCTTGGAAC | 321,370 | 87 |
| 527. | TTACTTGGTTTCCGGCCATTTTTT[A,T]AACTTGAATGCTGTGGCCATACTCT | 321,452 | 87 |
| 528. | ACTTGAATGCTGTGGCCATACTCT[T,A]AAGAATATCATTATGTTTTtCTGA | 321,478 | 87 |
| 529. | CCATACTCTTAAGAATATCATTAT[G,A]TTTTTtCTGAAAATATATGTGGTGA | 321,493 | 87 |
| 530. | GGTCCATGCATGGATCCAAAACTT[A,T]GGAGCACTATTCCTGGGAAACGTGG | 321,758 | 87 |
| 531. | AATTAGGTTTAAGCCCTTTAAAAG[G,A]GCCTGTGACGAACAGTGAACAGCAG | 324,295 | 87 |
| 532. | TAATCCACGTATTTTGATTATTTT[G,A]TTTTATTTCCTTTTTtCTTCCTGCTG | 324,624 | 87 |
| 533. | GATAAATGGAGCTAAAACCTTTGA[C,T]GCTTATACAAAGAATAACTTCAGTT | 325,487 | 87 |
| 534. | AGAGATAAGCCTAAACCATTGTCT[G,A]GTGCAGAGATTTTAAAGATGCTAGA | 325,761 | 87 |
| 535. | GTCTTTTGGGAGCAGAAATGTGAG[A,G]GCTAGATACAATCAATCCAATACTA | 325,826 | 87 |
| 536. | AGATACAATCAATCCAATACTATT[T,C]TTAATTGGAGGAAAAGAGTATTCT | 325,854 | 87 |
| 537. | ATGCATATTGAAAAAaTATTTAT[G,C]AAAATATTATGGAGACAATAAAGAA | 325,956 | 87 |
| 538. | GTTAAGTAGGTGTGTGAGTGAAAA[G,A]AAGCAAAAATTTTTGATATGAAGA | 326,189 | 87 |
| 539. | ACAAAACAATATCTCTGATGATTT[C,T]TTTTTTTtGGCTTTAGATTCATCAT | 327,134 | 87 |
| 540. | ATCTCTGATGATTTCTTTTTTTtG[G,A]CTTTAGATTCATCATTTGCTTTCAA | 327,144 | 87 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 541. | AACTATAATCAAGCCAAAACACAA[C,A]CATACCTTTTAGAATCAGAATAAAT | 327,847 | 87 |
| 542. | TTATATCTTTGCTTGTTTATTATG[C,T]AACAAGTATGCAATTAAAGAATCAT | 327,958 | 87 |
| 543. | TATCTTTGCTTGTTTATTATGCAA[C,T]AAGTATGCAATTAAAGAATCATGAA | 327,961 | 87 |
| 544. | ATGTTTGTTTGATTAATGCTACAT[C,A]CATTTAAGTTTCTATCATTTATATA | 329,332 | 87 |
| 545. | TCATATCTACCACTAGGTCAAAAT[T,C]ATTTTATCAAAAGGAGTATGAAATG | 329,711 | 87 |
| 546. | TTTTATCAAAAGGAGTATGAAATG[A,G]TAAGCTGTTCAAATTGTTGTATTAC | 329,737 | 87 |
| 547. | GTTTACATGTGTCTCTTAATTTTT[C,T]CTCATAAACATATGATAGATGAATC | 329,798 | 87 |
| 548. | AAACTAGATCATAACCTATTGTTG[C,A]AAGGGTGCAGAAGGATGAATAGTC | 330,065 | 87 |
| 549. | TAATCAATTGTTAATTCTCATGCA[G,A]TAAATTTTTCTCATCCAATTTGTAT | 330,205 | 87 |
| 550. | AGGGGCTGGTTATAAGTTAATTAT[A,G]ATTGAGACAGCAAAGACCATTCACA | 330,551 | 87 |
| 551. | AAGAGAAAATCCATGAAGAAAAAA[C,T]ATGTAGATATGCAAGCAAAGTTACA | 330,610 | 87 |
| 552. | TAGTTTGGTTGGCTAACATGATTT[A,T]GTTACACACTATTGGTGTTATGTCT | 330,884 | 87 |
| 553. | TGGTGTTATGTCTCTAATTTAATT[G,A]TCATTTGTTATTTGCTATTCTTTTA | 330,921 | 87 |
| 554. | TGTAATACCCGATCCATTTGGGCC[G,A]TGGATCAGGCCCAAAATCTGAGAGG | 331,052 | 87 |
| 555. | AAATTTAGAGAACGACGAGGATCG[T,C]CAGAGTTTTCTCTCGTGGAAGTCCTTC | 331,261 | 87 |
| 556. | CGAAAACAAAaGGAAAAGGGGCA[T,G]GTCCCTTATTTTTtGAATATTTTTt | 331,608 | 87 |
| 557. | TTTTTCTTTCTCTAATTGCATCAT[G,A]GACCATAGGATGAACTTGAGATGAA | 332,016 | 87 |
| 558. | ATTCATGCAGTAGGTTGGATCTCA[G,A]TCTGATCCTTATTCGAAATTTATAA | 332,093 | 87 |
| 559. | ATGATCACCATTATATATGCTATC[A,G]TTGGTATTGTATCATTGGTTTTGTA | 332,692 | 87 |
| 560. | GCTATCATTGGTATTGTATCATTG[G,A]TTTTGTATTGTTGAATCCGTGATCG | 332,710 | 87 |
| 561. | ATCTGAGAAAGATCATGAATATTT[C,T]GATTCGAGAAAGATTATAAAAGTCG | 333,063 | 87 |
| 562. | TGATAGATAATATCAGAGCTTAAC[A,G]TTATGATCATTAAGGATATGATAGA | 334,092 | 87 |
| 563. | AATATGATTTAAGTGGTATTTGAT[C,T]TTAAGATTATAATTATTCAAAATTA | 334,175 | 87 |
| 564. | TTTAATAATCTTTGGATTAGATTC[T,C]TTATTTATGTAATTCAAATCAAAAT | 334,905 | 87 |
| 565. | TTTATTTATGTAATTCAAATCAAA[A,G]TTAAAATTTCTGAGCTGATCTAAGG | 334,927 | 87 |
| 566. | GTAGTGAAGCTTATGTAATGAGTT[C,T]AAACATAGAAAGGTGGATGAAGATTT | 335,269 | 87 |
| 567. | AGATTTAATTTTGATGTGCTATGC[C,T]TAAGAGATAGTAATGATAAAGAAAC | 335,313 | 87 |
| 568. | GCTATGCCTAAGAGATAGTAATGA[T,C]AAAGAAACTTAAAAaTTTTATCGTA | 335,330 | 87 |
| 569. | GATTATTTTATTGTAGATAATGCC[T,A]AGAAGAATCCTAGACATCTCAAGTT | 335,654 | 87 |
| 570. | AATATGGCACAATATCAAACAAAT[A,G]TCTTTCAGAGCCTCCAGACATATGA | 338,811 | 87 |
| 571. | GATTTCGAGTTGTGTATGGGTCAC[T,C]AGTTTTGAGCTAATTCAATGTTTTC | 338,866 | 87 |
| 572. | ACGTGCCTAATATATGTAAATAAT[G,A]TTCTCAATTACTTTTAAGCATACGA | 339,971 | 87 |
| 573. | ATTTAAGTACTAAAAATTATATCT[A,T]TAAAGTAGCTAAGGTGTAATATAAC | 340,259 | 87 |
| 574. | TACTAAAAATTATATCTATAAAGT[A,T]GCTAAGGTGTAATATAACTATATGG | 340,266 | 87 |
| 575. | CTAGCAACCATGTATAATTCCTTC[G,A]CTAGCAACCAGGAATCCACTTCATA | 340,348 | 87 |
| 576. | CAAGTGATGATTAGGCTATCTAAC[G,A]TGGTAACCATCACAATGGCATAATA | 340,512 | 87 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 577. | TAACCATCACAATGGCATAATATC[C,T]ACAGTAGAATAGGAGCATGATCAAA | 340,540 | 87 |
| 578. | aTGCACTAATAGCTTTTGTAAAAA[T,A]TATCGCTAATATGACCTAGGATTCT | 340,690 | 87 |
| 579. | AGAAATAAAGAAGCTAACTAGTTT[T,C]ATCCTACTTATCAAGAAGTTTAGTA | 340,845 | 87 |
| 580. | GAAGCTAACTAGTTTTATCCTACT[T,C]ATCAAGAAGTTTAGTAACATTATAT | 340,854 | 87 |
| 581. | TGATTATGAACTTGTATTGTTATA[T,A]TCCCAATAATGTATGTAGTATATAT | 340,968 | 87 |
| 582. | ATTGTTATATTCCCAATAATGTAT[G,C]TAGTATATATTATCTATTTTTATAG | 340,983 | 87 |
| 583. | AAAAaTTTGGATTTGATTAGAGAA[A.G]AGTTTGGGCTTGAGAATTCTGGATG | 341,085 | 87 |
| 584. | GAATTCTGGATGCATTAGATTTGG[G,A]TATCTCAAGTAAAGCAAGATTGTGC | 341,123 | 87 |
| 585. | GCATTAGATTTGGGTATCTCAAGT[A,C]AAGCAAGATTGTGCCACAGAGTCAA | 341,134 | 87 |
| 586. | TCTCAAGTAAAGCAAGATTGTGCC[A,C]CAGAGTCAACCCTATGAGCTGCTTG | 341,150 | 87 |
| 587. | CCTAAGGGCTGGGCTTATTAACAT[C,T]GAGGGCGACTTAGTTATAGCGGTCA | 341,424 | 87 |
| 588. | CTTCCGCAGGATATTTGAAAAATG[A,G]TGAGAAAGTATTATATATATATATA | 341,504 | 87 |
| 589. | AGAAAGTATTATATATATATATAT[T,A]TTTTGATACTAAGTATGTTATTAG | 341,531 | 87 |
| 590. | AAGAAGACGCTGGGCCGCGCGGAG[A,C]CGCTACCCAAGTGGACCGACGCCGA | 342,246 | 87 |
| 591. | GATTAGGTTTTGTATTGGATGGAT[C,T]TTGATGGGTCTTGTCTTGATTCAGT | 342,477 | 87 |
| 592. | TGTTCATTTTCTTGGTCTTGGCG[T,C]TTTATTTGGGATTTATCTGAGCTTT | 342,661 | 87 |
| 593. | TATCAACAGTTGGATCTTTTGTTT[G,T]GAATGGTCTTATCTATATTGCATTT | 342,768 | 87 |
| 594. | GTGCAAGTACGTTTTCCCAAAATC[G,A]TATTAAAGATGATAGCCTGTGGAAA | 343,039 | 87 |
| 595. | GGAAGAAATTCATAAAGTCCCAGT[T,A]TATTTGACTATGTTCACTAAAAGAA | 343,530 | 87 |
| 596. | TGGACATGTTGCTTCTTATTATTG[C,T]TCATTCTTGACCAGTTATTGTAATT | 343,665 | 87 |
| 597. | CTTTCCTCATAATCAGGGCCTAAA[A,C]ATTTGATTTTGTTTTGGTTTTTCTA | 343,736 | 87 |
| 598. | TTAAGTTGCTAATCAATTAAATGC[A,T]TGAGGTTATAGAATATCATAATTAT | 344,205 | 87 |
| 599. | AGTTATTATCTTTCCCTCTTTTAA[C,T]TCAAGTAATGGAGAGAAAAGTCATT | 344,351 | 87 |
| 600. | GTTGTGCATTTAATTGTCGATACA[T,C]GAAATGACACATATACCATTCCTTT | 344,680 | 87 |
| 601. | CTGCATTTTGATGTGAAATGTAAA[A,C]TTCATGATACACTATTAATATTGAC | 345,208 | 87 |
| 602. | GTAAAATTCATGATACACTATTAA[T,C]ATTGACAGTAAAGGAACCAAACAAG | 345,227 | 87 |
| 603. | ACACTCATATTTCATCAGTGTTGG[C,A]GTTTTGAGATAATAATGCAAAATGA | 345,735 | 87 |
| 604. | AGATAATAATGCAAAATGACTGA[C,T]TTATAAACTGCAAATTTTGGTCTTT | 345,766 | 87 |
| 605. | TGACATCCTTACTAGTGCTTGACA[C,T]TTTTCTTTTAATTACCAATTCTTTG | 345,815 | 87 |
| 606. | TGGAATGGACCTCTTTTCCCTTTA[C,T]AGTTGAAAGCTCTAAGGGAATCAAG | 346,115 | 87 |
| 607. | TATTCAAAGAGCCCACATGGTACT[G,T]TAGCTTTATTACTGTCATACTTCTT | 346,226 | 87 |
| 608. | TGAGTGCAGCACATAAACAGGTTT[A,G]GCAATCATATACTATATTTTGTACA | 346,402 | 87 |
| 609. | TCAATCTGCAGTAATGCTGAGCAT[T,A]AGCATTTGAAAGATAAACCTTTTTGT | 346,558 | 87 |
| 610. | CAATAAAAGTTAGTGCATAGTTCC[T,C]GTGTTTACTCTTTAATGATTATTGC | 347,298 | 87 |
| 611. | TTAAACTCATGAGACCAGAAGATA[G,A]GGCTGTGAATTGATCTGAGATGCTT | 347,762 | 87 |
| 612. | CTGAGTGATCATGTATTTCACAAT[G,A]TATTTAATACTTTTTAGATTTATAT | 347,982 | 87 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 613. | TAGATCATTACAATGCTCATTCAC[G,A]AGCAGGAGCATGGGCCACAGGTGTT | 348,176 | 87 |
| 614. | AGTGATGAGAGTTAGAGAGAGTGC[A,G]AGTGAGCCAGATTTTGCTGGCCATG | 348,283 | 87 |
| 615. | AATTTCCCTAATTTGAACCATTAA[G,A]TAATTGGATAAAAAACAGATAATTC | 348,491 | 87 |
| 616. | GGTGTCCAACACTGCTTAAACACA[C,T]AGCTAGAGTGTATCTGCTTGAGTCA | 348,687 | 87 |
| 617. | GAGCCTTTTTTTTtGGTTATGTT[C,T]TTCTCTACTTTGCCATTTCTGTATG | 348,872 | 87 |
| 618. | CATATCCGTCCCCATCCTATATCC[A,G]TTTTGGGTCGAATCAGGTCGAGTAA | 349,156 | 87 |
| 619. | AGAATGGATTGGGTCGGGTCGGGT[T,C]GGGTATCTTCCCTTGCATGGGGTCG | 349,257 | 87 |
| 620. | ATATAGAATAATTGGGAAAACAGT[G,A]GTTACAACAGCAATACATGCTCACA | 349,721 | 87 |
| 621. | AGCAATACATGCTCACAACGGCAC[T,A]ACCCACTTAAACATAAAGGCTACTA | 349,754 | 87 |
| 622. | AAAGATAACCACCCTCCTTACCAA[A,C]AAAaGATTTCACAAATTATGGGGAT | 349,867 | 87 |
| 623. | TATGTTATCCGGTCAGGTTCGAGA[T,C]GGGGCATACTATTATCTGCACCTGA | 350,326 | 87 |
| 624. | GTGTGCCCTTCAGGTGTTATGAAT[T,A]TTCCCTTTTGCTTTTACCTGATTAG | 350,591 | 87 |
| 625. | TCATTAAATTGTGCAGCCAGGTGA[C,A]TTTTGCGCTTAATCTTTGGGAACAG | 151,708 | 87 |
| 626. | CTCTCTCATATATATGCTCGGTAG[G,C,A]CCACGGGAGTACCAGCCCATGCTGG | 351,794 | 86 |
| 627. | CTTTAATTTTCATGATTATATAAT[T,C]TGACTGTTACTCTTGATGAAAGATA | 353,306 | 86 |
| 628. | AAAATCAAAGAAAGCTTCTACTTC[T,C]ACCCCAAAATAAGGAAATCTTTTAC | 353,362 | 86 |
| 629. | TGTGGCACGTACGTGATACGTCCA[A,T]ATTTCGAGATGCCTTTCCAGGGCAT | 353,596 | 86 |
| 630. | TCCAAATTTCGAGATGCCTTTCCA[G,A]GGCATGCAGCTCCTCCAGTGTCATA | 353,616 | 86 |
| 631. | CTCCAGACATGTACCTGTCACCCA[A,T]GTTCTTTGAACTCATGCACAAACTT | 353,685 | 86 |
| 632. | GTTGAGGCAGGCAAAAACGGAACA[C,T]ATATTTAAGCATGCAACCACAACAA | 353,813 | 86 |
| 633. | GTTTATTGGTAAAGAAAGGTCCAT[T,C]CAACCATCCACTAAACTAGGAGAAG | 353,893 | 86 |
| 634. | TATTGGTAAAGAAAGGTCCATTCA[A,C]CCATCCACTAAACTAGGAGAAGGCT | 353,896 | 86 |
| 635. | TCGTTATAAATTCTAACTCTCTCC[C,T]AATTCATGATTACATGTGGAAGGA | 354,013 | 86 |
| 636. | GAAGCAATAAATTATGAGTTGCAT[T,C]CTTTGTGACAAATTGGCCTAGAGCC | 354,061 | 86 |
| 637. | AATTTTATTCTATAAGAAACACTT[C,T]TTTTGAGATATGAAGAAATTGCATA | 354,308 | 86 |
| 638. | GCTTTGTACCCCTAGGTATGGCTT[G,T]TCCTAGAGTTTTGCAAACTGCCAGG | 354,523 | 86 |
| 639. | GAAGTTGCTAAAATGACTAAAAAA[T,A]GAAAAGAGGAGACCTGATGGTGTGT | 354,708 | 86 |
| 640. | AAAAAATGAAAGAGGAGACCTGA[T,C]GGTGTGTTACCATTCTGTCTCATTT | 354,726 | 86 |
| 641. | TACCATTCTGTCTCATTTAAGCCT[A,C]AATCATCCAAAGCTATTTAGGGGTG | 354,758 | 86 |
| 642. | TCATTTAAGCCTAAATCATCCAAA[G,A]CTATTTAGGGGTGCGCCTAGGTTCC | 354,770 | 86 |
| 643. | CGGCGGCCTAATGCGCTAAGGATT[G,A]TGTTGTAAGTAGATATTGGAAAAAG | 354,819 | 86 |
| 644. | CGGCTAGGGTTTCATTCTTTATCC[T,G]ATTATGTTCATCCTTCTCGGTTCCT | 354,917 | 86 |
| 645. | TTCTAGTAAAAAaCTAATATGAAA[T,C]TAAATACATGCTCACACGACAGTCT | 355,168 | 86 |
| 646. | GTCCTAGGTTGTTACAATTATAGT[G,A]AAAATTTTATTATTACACTAAAGGA | 355,283 | 86 |
| 647. | TTTAAAATATTTATTATTAAAAAA[T,G]TATATGATTTGGAGATCCCTACTTA | 355,720 | 86 |
| 648. | GGGATCTCCAGACTGTATGATTTT[C,T]TGATAGTAAATAGTTTAGAGATAGT | 355,856 | 86 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 649. | ATCTCCAGACTGTATGATTTTTTG[A,G]TAGTAAATAGTTTAGAGATAGTAGA | 355,859 | 86 |
| 650. | GAAGGCATAGCTTATATATTAATG[C,A]TATCATCCAATTAATTTATGTAATT | 356,240 | 86 |
| 651. | CCTAAACCCATAGGCATGAAGAAT[G,A]GAAATCATGTATTACAGAAGCCTGT | 356,378 | 86 |
| 652. | ACAGATAAGCTAACTAAAAGAGGG[T,C]AAGTCTTTGTTTTTTtAGAAGAAAA | 356,464 | 86 |
| 653. | TCAGGATGATAGATTGTCATCGTC[G,A]TAGAGGGTGACTCTATAACAGTGGT | 356,528 | 86 |
| 654. | TCTATTGTGACTTAGATTTTATGG[A,G]TTTAAAATACAGAAATAGCCTCTTT | 356,900 | 86 |
| 655. | TATGTTTGACCCTCATTTGATCCC[A,G]CAGTAACGAGGGCCTTGTGCATTGG | 356,971 | 86 |
| 656. | ATTTCCTCCACAACACCAAATTTT[G,A]CTTTTttTTTTtCTTTTGAATCTAG | 357,110 | 86 |
| 657. | TATATGCACGTGAACAAATATTGC[A,G]TGCATAGGCATGATCACATGCATGA | 357,332 | 86 |
| 658. | AGGCATGATCACATGCATGAATGC[G,A]CACAGATGTGCATGTACATATTTAT | 357,362 | 86 |
| 659. | CATGAATGCGCACAGATGTGCATG[T,A]ACATATTTATGCATAGACACAAGCA | 357,377 | 86 |
| 660. | ATGTGCATGTACATATTTATGCAT[A,G]GACACAAGCAGGCATGAACAAACAC | 357,392 | 86 |
| 661. | CGGTGCAGAGAAATTATAGCTCTG[G,A]AGTGCGTGCAATTTTGTTTCTTATT | 357,476 | 86 |
| 662. | AAGGATTTGAGGTGTTTAAGTTGG[C,T]CATTCGTAGTACCTAGCAAACAGTA | 357,583 | 86 |
| 663. | TTTCCTACCATGCTTTTCTGAATA[G,T]CCCACTTTTATATGGCGATAGTGAG | 358,143 | 86 |
| 664. | CAATGGGCCCTTGCAAGTCTTCAT[G,T]ATACATATAATTCTTGGTTAATGAG | 359,208 | 86 |
| 665. | GGAGGCTCTCATTGATGGGAATCC[T,C]CCTCCACCCACCAGTGACAGTCTAT | 359,475 | 86 |
| 666. | AACTGAAGCTGAGACATGGAAGAT[C,T]ATGTGTAATAACATTTATGTGGCAG | 359,837 | 86 |
| 667. | TTTCCGAAGGAATCAGGTCATCAG[T,C]GAACATTCTTTGGACCTCATATAAG | 360,112 | 86 |
| 668. | ATTCCATTTTAGCCACATATGCAC[A,G]TACTCATTTTGCGTGAACTCTCGTG | 360,163 | 86 |
| 669. | TATGCACATACTCATTTTGCGTGA[A,T]CTCTCGTGTGTTTTTCATATAAATT | 360,180 | 86 |
| 670. | TTTGCTTGAAGTCACATTGAAGTT[T,G]CCCACTTGATTCAGTTTGCTAAATT | 360,589 | 86 |
| 671. | AAAAGCCGCCTCTCTTTTTCTCCC[A,C]AGAAAAAGAGAGATAGTGGTAGTGC | 362,274 | 86 |
| 672. | ACTTAACACCTTTCATCTCTTTCT[T,G]AAGATAAGAAAGAATATTTTGTATA | 362,390 | 86 |
| 673. | TTTGCCTAGGTCTCTATTGTCACC[C,T]AGTGAATTGTTTGAGACTCTAAAAT | 362,514 | 86 |
| 674. | AAGTATCCTTTAAAGTTTGCACAT[G,A]TCATTCATGACTACATCAAGTAATT | 362,596 | 86 |
| 675. | TCTTCAAAATGCAAATCTATGAAT[G,C]GAGAATTATAGGTGTGCCAGATCGA | 362,652 | 86 |
| 676. | ATAACTCAAAGATAAAATAACCAA[C,T]GAATAACATTGATTATAAATAAGAA | 362,815 | 86 |
| 677. | TTGATTATAAATAAGAATAATTGA[A,G]TATAAGTAATTCTTTAGGGAGATTT | 362,848 | 86 |
| 678. | TTGATTTTCTCCAAGATGGAATGA[A,G]ACATCACATTAGAGAACTATTGATT | 362,946 | 86 |
| 679. | ATAAAACTTTTTCTATGTTGGGT[G,A]GTTAAATATCCATGCATGCATAGAG | 363,047 | 86 |
| 680. | TAGCTCCTCTTAAATAGTTAATTC[T,C]AATATTTGACCACCCAAATATGACG | 363,253 | 86 |
| 681. | TAATATTTGACCACCCAAATATGA[C,T]GTTTTATATACGTGCCAAGTGGCCA | 363,277 | 86 |
| 682. | AAAATAATTATTAATTAAATATTG[A,G]TTGGTATAATAATATTATTCATTTA | 363,354 | 86 |
| 683. | TTTATTATAGTTGGTTGATGGTAA[C,A]TTAATTCATAGGGATAAACATTACC | 363,400 | 86 |
| 684. | TAGTAACATGCATGATCATAGGCA[T,C]CATTTTATGTGGATTGATCATGCCT | 363,617 | 86 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 685. | ATGATCATAGGCATCATTTTATGT[G,T]GATTGATCATGCCTATCAACCATAA | 363,628 | 86 |
| 686. | ATAACAAGTCTCTACTCACAGTCC[C,T]CTTATTATTGTTGTCGAGCATATAT | 363,674 | 86 |
| 687. | ACCAATTATAATAATTATTATTGG[T,A]CAAAATAAATTTCAATCTATAATTT | 363,919 | 86 |
| 688. | TTTTATAACCAATTGGATCATTGC[G,C]TCGCAAATATTTGAGTACTTTCAGT | 364,074 | 86 |
| 689. | TCATTGCGTCGCAAATATTTGAGT[A,G]CTTTCAGTTGATCAGCCTTTTCAAG | 364,091 | 86 |
| 690. | TTATTAATTCACTGCTAATTGCGA[A,T]ATAGATCACTTAGGCTCTTTAAGCC | 364,147 | 86 |
| 691. | TGGGGCCATCAAGGAGAGCATATT[A,C]ATATGATCACATATATCAACCATTC | 364,292 | 86 |
| 692. | GATCATTCCCTTCAGAAAGCTTCA[G,C]TTTATTTCATTGCCTTGGAGCTTTT | 364,544 | 86 |
| 693. | AGCTTCAGTTTATTTCATTGCCTT[G,A]GAGCTTTTCTTTGACATTTTATCCT | 364,561 | 86 |
| 694. | AGAATTTCAAAGCTCACTAGTGAT[A,T]GCAATTGAATAACAACAAGAATACA | 364,743 | 86 |
| 695. | AAAGCTCACTAGTGATAGCAATTG[A,C]ATAACAACAAGAATACAAACCCAAG | 324,751 | 86 |
| 696. | GATCTCAATGCCGTTTGCCCATGA[T,C]CATCATGTGACCACACCTGGCCCAC | 365,500 | 86 |
| 697. | CAATCATACATAGCTTCTGATTTT[G,T]ATCATACATCACCTCTGATCCGACC | 365,554 | 86 |
| 698. | CAACTTGAGTGCCCTCCACAGCTC[G,C]GATAGGTCAAGCCTAGAGAAGAAGG | 365,678 | 86 |
| 699. | TCCACAGCTCGGATAGGTCAAGCC[T,C]AGAGAAGAAGGATATTAGATTGAAG | 365,692 | 86 |
| 700. | GCCGCATGGCACTTCACCACTGTC[A,G]TTTGCTCCTCCTCGAGAGCCCCTTC | 365,817 | 86 |
| 701. | CCCCTTCTTGAACCAAGGATCGCA[A,G]AGGATCCCATCGATGGTGATCCTTG | 365,860 | 86 |
| 702. | TTGGGGCATCGGTACTCCCTCCAA[T,C]AGATCTTGCAGTTCATCGCCATCAA | 365,969 | 86 |
| 703. | TTAAGGACGTAAAGAATAATGCTG[T,C]AGGACCAGATGTCGATCTTGGTGCC | 366,050 | 86 |
| 704. | TGGCATTATCGAGGAGGAGGTTCT[T,C]TGGCTTGAGGTCCCAGTGGTAGATG | 366,231 | 86 |
| 705. | CTTGAGGTCCCAGTGGTAGATGCC[G,A]CGTGCATGGCAGTATTTGATGGCGG | 366,259 | 86 |
| 706. | GATTCGTTGGCAGAAGTAGCATTG[A,G]GAGAGGTCCTCAAGAGATGGCCTCG | 366,310 | 86 |
| 707. | ATGCATGCATAGAGCTTGCTATTG[C,T]AGGCGAGCTTGAGGACGAAGTAGAT | 366,364 | 86 |
| 708. | GCGAGCTTGAGGACGAAGTAGATC[T,A]TGGAGCGGGAAGCGAGGACCTTAAG | 366,391 | 86 |
| 709. | TCTTGGAGCGGGAAGCGAGGACCT[T,C]AAGGAAGTGAAGGATGTGGGGGTGA | 366,413 | 86 |
| 710. | AGTGAAGGATGTGGGGGTGATGGA[A,G]GTGGCCGCATTATGGCGATCTTGCGG | 366,443 | 86 |
| 711. | AAGTGGCGCATTATGGCGATCTTG[C,T]GGATGACATTGTGGGCATAGCCGCC | 366,466 | 86 |
| 712. | GGCCCTTGGGGATGGCCTTGAGAG[C,T]GATGCTTTGATTAGAGTAGAGGTTG | 366,527 | 86 |
| 713. | CCTTGGGGATGGCCTTGAGAGCGA[T,C]GCTTTGATTAGAGTAGAGGTTGTGA | 366,530 | 86 |
| 714. | GCATATAATTGTTTAATGAGCCAC[G,A]TGCAGTCACGTGATAGTTATGGACA | 366,624 | 86 |
| 715. | TTAGCCAAATTGGCAAACATGAAA[T,G]TTGGATCACTTGATTGCTAATATCT | 366,731 | 86 |
| 716. | GAAATTTGGATCACTTGATTGCTA[A,G]TATCTCTGAACTTCATTATACAAAA | 366,751 | 86 |
| 717. | TATCTAACTTACACTACAACAAAA[C,T]AAGATATTAGCATAAAAAAAaTTC | 366,826 | 86 |
| 718. | AAATCAAATTTAAAAAaGCATTAG[T,C]ATCACTAATAAATATTAAATTAAATA | 367,132 | 86 |
| 719. | ATCATAATTTCTGACATAAATTTT[T,C]ATCACTAATAAATATTAAATTAATA | 367,180 | 86 |
| 720. | CACTAATAAATATTAAATTAATAA[C,T]GATAAAAATATTTTCATCACTATTA | 367,207 | 86 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 721. | GGTTATTTACGATGAAAATATTTT[T,A]ATCGCTATTAATTTAATTAAAAATT | 637,326 | 86 |
| 722. | ATTAATTTAATTAAAAATTTTTAT[G,A]AAAATCAAATTTAGAAAAATATTAG | 367,357 | 86 |
| 723. | AAAATCAAATTTAAAAAaTATTAG[T,C]GATGTAAATTTTACATCTCAAATAT | 367,489 | 86 |
| 724. | TAAATTTTTATCGATAATAAATTT[T,G]tAATTATTTATGATAAAAATATTTT | 367,553 | 86 |
| 725. | TTTTTTATCGCTAATATATTTTTt[A,G]ACGACCAATATTTCATCGAAAATAA | 367,670 | 86 |
| 726. | AATAAATTTATAAATAAATTTTAT[T,C]ATTTTATTATATTAAATTAAAATTA | 367,834 | 86 |
| 727. | TTTTATTATATTAAATTAAAATTA[C,T]AAGAGACCTAAAATAAAAaTAAAAA | 367,860 | 86 |
| 728. | GCATAGATGTCAGTCCTGAATGAG[T,C]GTGAGGATGAGGTAGCAGTGATCCC | 368,153 | 86 |
| 729. | GATCTCATACCAAGCACCTGATCA[C,T]AACTCTCGCCATCTGTGGGTGCGAT | 368,228 | 86 |
| 730. | GCACCTGATCACAACTCTCGCCAT[C,T]TGTGGGTGCGATCGAGCCCTCTGGA | 368,241 | 86 |
| 731. | ATAAAGAGCTCCTAGCACTCCGTC[A,G]TTCACTCTTTTGATCGTCGCTGGTG | 368,400 | 86 |
| 732 | AAaTTGGATGTATAATCTGATATG[C,T]CGGATCCTTGTAATATCGGTATATG | 368,746 | 86 |
| 733. | AGTGATGCTGTCATAGGGCCGCTG[T,C]CGCATTGCCTCCACCTCATGATCCT | 368,813 | 86 |
| 734. | GAAATACAAAGATAAATGAGCATC[T,C]CGCATTGCCTCCACCTCATGATCCT | 368,909 | 86 |
| 735. | CCCTATCAATAACAAATATTAGAA[A,G]AATACTATACTAATTAAATATTCAC | 368,982 | 86 |
| 736. | AAAAGCGTCACGGGGCATAACTGC[A,G]GCATATGATGCCCAGCTTGATCTGC | 369,103 | 86 |
| 737. | AACTGCAGCATATGATGCCCAGCT[T,C]GATCTGCCACAGCTCGTACCATCTC | 369,121 | 86 |
| 738. | GGAGACACTATCTCGGGTACTCGC[A,G]TCTCCAATACTCTAAAGCGAGGTTC | 369,208 | 86 |
| 739. | TCACCTCACTACCGGTGGAGACTG[G,A]CCTGAAACAATAATAAATAAATCAT | 369,275 | 86 |
| 740. | CATCTTTCTCCTGGTGCCATACCT[A,G]CAATTCTTGACATATAAATGAATAT | 369,509 | 86 |
| 741. | CATATAAATGAATATAATATTAAA[T,C]AATAATAATAAAAAaTAAATTATAT | 369,544 | 86 |
| 742. | ATCGCATACCATTATTGCAAGAAA[A,G]GATTGAACAAAGAATATAGATCTAC | 369,612 | 86 |
| 743. | CTCATCGTCATTTATGAACTGATC[A,G]TCGTCCTCTGACTCATCAAGATTAA | 369,739 | 86 |
| 744. | GTTAGACGGTAGATTACGGGTATT[T,C]AAAGGAGTCATTACAAGTTCTTCAT | 369,811 | 86 |
| 745. | AGATTAGCCCTATTTAAAGGAGTC[A,G]TTACAAGTTCTTCATCAACAAGAAG | 369,821 | 86 |
| 746. | AAAGCTTCCTCTTCATGTAAATTT[G,A]AATTTTCATCCATCTCTAATCGGGT | 369,899 | 86 |
| 747. | TTTGAATTTTCATCCATCTCTAAT[C,T]GGGTTGGTATGTCATATACACCTCT | 369,920 | 86 |
| 748. | TTTCTTAAATATTTTtTTTCTAAA[C,T]GAGCTCCGGACTCGGCTTCCCATAG | 370,043 | 86 |
| 749. | CGGACTCGGCTTCCCATAGCCCCC[G,A]CTCCCACGGCGCCGGCGTCGTCACA | 370,958 | 86 |
| 750. | AATAGTTAATTTATGATTTTTTCT[C,T]CAAAAAaTTATGTACATAAAAAaT | 371,958 | 86 |
| 751. | TCTCCAAAAAaTTATGTACATAA[A,C]AAaTATAATTTTGATGAAAAATTTA | 371,979 | 86 |
| 752. | CAACTTCCGCAATGGAATAAGCAC[C,T]ATAGGAGATCGATAGTTTTGAGGTC | 371,066 | 86 |
| 753. | TCTTCTTCTTGGAGTCCCTGTTCT[G,A]GAAGTCGGAGTACTTGAATGTCGCG | 372,136 | 86 |
| 754. | AAGTCGGAGTACTTGAATGTCGCG[A,G]TGATTCTGAGATCGCGAGAGAAATC | 372,162 | 86 |
| 755. | ATGAAAATATTGATAAAATAAGAA[T,A]TATCTTTTGTATTGCGTCTATCTCA | 372,248 | 86 |
| 756. | CTCTCTGAATCCCCGAAGTAACTG[C,T]TGTCCACTGTCCAGGAGCTCTACTC | 372,638 | 86 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 757. | TCCCCGAAGTAACTGCTGTCCACT[G,A]TCCAGGAGCTCTACTCCTTCTCTTT | 372,647 | 86 |
| 758. | AAGTTATCCGCGCACCACATCAAA[A,T]GTCAGGCCACACCATAACCCTTCTG | 372,755 | 86 |
| 759. | CAGGCCACACCATAACCCTTCTGT[T,C]CACGGTCACAGCCTTTTAAAGGCTT | 372,782 | 86 |
| 760. | AAGATGATTAATATAAAAAAGCAT[G,A]CCTCATAAACTATAAAATAGACTGT | 373,749 | 86 |
| 761. | TATAAAAAGCATGCCTCATAAAC[T,C]ATAAAATAGACTGTTTACAAATAAA | 373,760 | 86 |
| 762. | ATTTATAATAAAAAAaTTTCATCG[C,T]AAATAATAATCAATTTTTGATTTTT | 373,862 | 86 |
| 763. | ATTTATGATGAAAATAATATTTTC[G,A]TCATAAAAAAaGTCATTTACGATAA | 373,956 | 86 |
| 764. | ATTGATGATCAAAATATTTTTAAT[G,A]TAAATAATCTATTATTTATGATGAA | 374,781 | 86 |
| 765. | AAAATATTTTTAATGTAAATAATC[T,C]ATTATTTATGATGAAAATCGATTTT | 374,791 | 86 |
| 766. | GTTTTTGAAATATTTTAAATTTCT[C,T]ATTTTTTTtCTAGATATTGACGATG | 374,896 | 86 |
| 767. | GCCGACGAAAAAATATTTTTCATC[A,G]TAAATAATTAAATTATTTACGACGA | 374,974 | 86 |
| 768. | ACGACGAAAATATTTTCATCGTGA[G,A]TATTTTAAAATTTAAAATTAAAATA | 375,017 | 86 |
| 769. | AATAAATAATATATTATTTACGAT[A,G]AAATATTTATCATAAATAATTTGTA | 375,063 | 86 |
| 770. | TGCATGTCAGCAAAAACTTGCAAT[C,T]TAAGACTTAATGCGAAGCTGCGGCT | 375,695 | 86 |
| 771. | GGAAGGGTTTATGAAGAAAGTAAA[G,C]CTATTACGCATAGCAAGTAAAAACA | 375,785 | 86 |
| 772. | GGTTTATGAAGAAAGTAAAGCTAT[T,C]ACGCATAGCAAGTAAAAACATTATT | 375,790 | 86 |
| 773. | CATAGCAAGTAAAAACATTATTTG[C,T]TTATCTTTTCTCATGCTACAGCACA | 375,818 | 86 |
| 774. | TGCTACAGCACAAGTAAACCAATG[C,T]AACATACATGCTTCAAGGGGCTGCC | 375,856 | 86 |
| 775. | GTATTAACTTAAAAAGGAACTACC[A,C]AAAAaTTTACAATCTAGAGAGCAG | 376,064 | 86 |
| 776. | TAAATGACAGTGGCAAATTAAATG[C,T]TAAAGCGCCATGCTAATTCCAGTTC | 376,448 | 86 |
| 777. | GATAATCTTCAATAAGATCCAGTG[A,G]CACAAGTCTTTGTAGGCATAAATGT | 376,572 | 86 |
| 778. | TGTTCAATAGAAACAACAGGCAAT[A,G]GGGTATAAATACAAGCACATTAGCA | 376,765 | 86 |
| 779. | AATACAAGCACATTAGCAGCTAGA[T,C]ACAGACAATATTCTGTGATACCCTA | 376,797 | 86 |
| 780. | TCAAATCAATGTGCAATTTAAAGC[A,C]AGATGACTGTGTCACATCCCAGACA | 376,878 | 86 |
| 781. | CTTTACGGGGAAGTAAAAAaTACA[T,C]CATTCTTTTGAATAAGGTATTTGTC | 377,039 | 86 |
| 782. | TAAAAAaTACATCATTCTTTTGAA[T,C]AAGGTATTTGTCCTCATATTGCTAG | 377,052 | 86 |
| 783. | AGACGCATTGGGAAAAAAAAaa[G,A]GTAGCTCAGTGCACAAGGCTTTCAGC | 377,251 | 86 |
| 784. | CTCAGTGCACAAGGCTTCAGCCAG[G,T]GTAAGGTCTGAAGAGACTCCAGCCC | 377,280 | 86 |
| 785. | AGGCTTCAGCCACGGTAAGGTCTG[A,G]AGAGACTCCAGCCCTACCCCTGCAT | 377,291 | 86 |
| 786. | AGAGACTGTTTCCATATTTCAAAC[T,A]GTCACAATGGGCAACTTTAGCATTG | 377,345 | 86 |
| 787. | GCGGTCCAGCTTTATCTTCAGCTC[A,G]GTACATTGCCCAAAGAATTTTGCAA | 377,511 | 86 |
| 788. | GCATCAGGAACCAAAAGAAATGGA[A,G]AAAAAAaTGAAAAGGATGGCACTAA | 377,955 | 86 |
| 789. | AATATGAAGCCAATAAGGAGATGA[A,G]CTACCTCTGCACACATCGGATGCCT | 378,013 | 86 |
| 790. | TCCAACATTCTAAATTAAGAATGA[T,G]GCGAAAAAACTATAGAAACTGAACC | 378,099 | 86 |
| 791. | CTGCACCAATTTCCAAGCTTAAGG[G,A]CCACATGAATGTGAAGTTTCCCTAC | 378,333 | 86 |
| 792. | ATGAATGTGAAGTTTCCCTACACT[A,C]TCCATCCTCAATTGCTATGTTAGAG | 378,362 | 86 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 793. | ACTATCCATCCTCAATTGCTATGT[T,C]AGAGAAGCACTTCAATGGTCAATGT | 378,383 | 86 |
| 794. | TTGATCCATTTACTGACAAAACAA[C,G]GTATCAGCTCTAAATCCAGTCTGCT | 378,745 | 86 |
| 795. | AATTAAGAGGGATCATATCATGCC[A,G]ATTCCTAATCTGTATCCAGTCATGC | 378,796 | 86 |
| 796. | TCATGCCAATTCCTAATCTGTATC[C,T]AGTCATGCTCACCATACAAATACAT | 378,813 | 86 |
| 797. | CAGGCATACCAACAGACATAAGTC[C,G]TAATTTCAGTTGACAAATGATATTC | 378,935 | 86 |
| 798. | ATTTCCAAAAATGATCCACCAGAG[C,T]CATTCACTAGCCTAAATTTTGCTTG | 379,228 | 86 |
| 799. | AAATATCTTAATTAAGTTTAATAT[G,C]AAAAAaTAGCTATTCAATTTTATC | 379,711 | 86 |
| 800. | TGCAGTGCTACCAACTATGCATTG[T,C]CAAAGGGTCTAGTACTTGGATTATC | 380,092 | 86 |
| 801. | GTGGGCTCTAACTTCTTAAGTTGT[C,T]GACACAAGGGTCCAAAGGTTTAGGT | 380,171 | 86 |
| 802. | AAGGCATTCATCTTTATATTCATA[A,G]CCTACAAAGCATAATTGCATCTGTA | 380,312 | 86 |
| 803. | TTGGCATGTACATGATTCTTGGTA[T,A]GGGAAGGGTGGAAGGCAAGAATGAA | 380,864 | 86 |
| 804. | GTGGAAGGCAAGAATGAAAAATATG[T,A]GATTTTTTTCATATAGAACTATGGC | 380,896 | 86 |
| 805. | CCATGTAGGAAACAAGAAATTCAT[G,T]CTAATGGGACTATAGAAGCATATTC | 381,109 | 86 |
| 806. | TTTATCTATTCATTGCAAGCTGCT[G,A]TATCCACATTTATCTGTCAGATTAA | 381,455 | 86 |
| 807. | TCCCTACTAAAGTCATATTTTGCC[C,T]GTGAGCATTAAGTCTCATGACCTGT | 381,660 | 86 |
| 808. | ACGAACTGAAAGACTATGAAAACA[A,C]ATCAAAATACGATTGCAACCATATA | 381,824 | 86 |
| 809. | CATCACCAACACGAAGTGCCAGTA[T,C]AAAAATAGGGAGAATTTTTTTTTTt | 381,914 | 86 |
| 810. | TCATCATACCTATGATCTTGAATT[T,C]GGATGAGAAGATCGAACAAGAATAC | 381,991 | 86 |
| 811. | GATCTTGAATTTGGATGAGAAGAT[C,A]GAACAAGAATACAGGGCTTTCAGAG | 382,004 | 86 |
| 812. | TGTCATCTTGGGCTCCATGCCAGC[A,G]TGGAGGCCGAAATGGGGATGCTGAT | 382,067 | 86 |
| 813. | GTGACCCAAGCCAAACCTCAGTCT[C,A]AACCAGACAAGGAAACCTGGGAATC | 382,137 | 86 |
| 814. | TCTCAACCAGACAAGGAAACCTGG[G,A]AATCTGGGATATTGATGGAGGATTG | 382,158 | 86 |
| 815. | ACCAAGCCATCAAAAGGAAGGCCA[T,A]AGCCTAGAAATCGAGAACTGCAACC | 382,276 | 86 |
| 816. | TCGAGAACTGCAACCCATAACAGA[C,G]GACTAATGAACCTATTGAACGACAA | 382,311 | 86 |
| 817. | ACAATCAAAATTTAACATTAATTC[T,G]CCATGTTTTCTTTGAAGCAGATAAA | 382,836 | 86 |
| 818. | AGGAGCGTCCGCCAGCTTTGATTG[T,G]AGAACGGCGACCGGCGACGGCACGA | 382,242 | 86 |
| 819. | ATTCAGGGAGAAGGCTCTCGCACG[T,G]GATCGAAGACAAAGAGTAGGGAGAG | 383,291 | 86 |
| 820. | TGGCGTCAAAGTCCCCTTTTTTTT[T,A]CGATTTTTTCCGCGATTCATGTATCG | 383,833 | 86 |
| 821. | GGCGTCAAAGTCCCCTTTTTTTTt[C,A]GATTTTTTCCGCGATTCATGTATCG | 383,834 | 86 |
| 822. | TATTCCTGTTTTACCTGAATTCCG[G,C]ATCGCTGGATTTGTACGCGTGTGAA | 383,886 | 86 |
| 823. | TCCCTGCAGACTCCATATCTGAAA[C,T]TCCAGGGGATGAAAACTTGAGTAGG | 383,386 | 86 |
| 824. | TACATCCCTCGGTACTATATTTCT[C,T]TTTTtTTTCTATACAGAAAATGTTC | 384,833 | 86 |
| 825. | GTGTAAAATCAGGCCTTAATGCTT[C,T]TGTTGGGAAGGAATCCTCACGAGTG | 384,970 | 86 |
| 826. | CTTAATGCTTCTGTTGGGAAGGAA[T,C]TGTTGGGAAGGAATCCTCACGAGTG | 384,984 | 86 |
| 827. | ATCTAAGAGCGCTAATTCAGGTGA[T,C]GGTGTCAATACCGCAATAAGAAGAa | 385,037 | 86 |
| 828. | CACCTCTGATCGTTCAATCACGAC[C,T]GCAAGCTCTTCTGACCTTCAGATTG | 385,406 | 86 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 829. | CAGGGCAAGCTCTTCTGACCTTCA[G,A]ATTGCGCAAAACAATGCATGAACCG | 385,427 | 86 |
| 830. | CAAGCTCTTCTGACCTTCAGATTG[C,T]GCAAAACAAATGCATGAACCGCGCAT | 385,432 | 86 |
| 831. | ACCGCGGCGGTCCACGCGCGATGC[G,A]TGGACTGCGACTTCCTGTGGATGCG | 385,586 | 86 |
| 832. | GACCGTGCTGTGCACCATGTGGGC[G,A]CGCTAGTCTGGGCTGAGCATGTCAA | 385,641 | 86 |
| 833. | TGCGTTGTAGCGAGCTTGGGCGGC[T,C]TGCGGGCCTACGAGCCACGCTTGTA | 385,740 | 86 |
| 834. | TGTAGGCTTGCCGCCTGTGTCTAC[A,G]TGCCTATGGGGCTGGACTTCTCTTT | 385,786 | 86 |
| 835. | ATTCAACAATCTCCACCTCGACTC[G,A]ACATTCGGCCTTCACCTAACTTTAA | 385,871 | 86 |
| 836. | TTCACCTAACTTTAAGAACTTCTA[G,T]ATCATCTTGCCCCCCATGTCTTGGGG | 385,906 | 86 |
| 837. | GCCCCCATGTCTTGGGGCAAATGT[T,C]TGGCTGCTCATGGATGGGCAAACAT | 385,939 | 86 |
| 838. | GCTGCTCATGGATGGGCAAACATG[G,A]GAGTCGAGCCAGACCGCTGATACC | 385,966 | 86 |
| 839. | AGATCTGATCGGGGTAGCCTCCTG[C,T]AGTAATAGAAACTTCATTCTGCGAT | 386,049 | 86 |
| 840. | ATCTGATCGGGGTAGCCTCCTGCA[G,A]TAATAGAAACTTCATTCTGCGATGT | 386,051 | 86 |
| 841. | TTCGTCTCATGCCCAATCCATCTG[T,C]ATCTGGAGCTCCACCTCGTTCTGAG | 386,123 | 86 |
| 842. | AAGCTCTACCTCATGCTGAGCTCT[C,T]TGTCAAGAGGTAATGTTCTCCATAC | 386,189 | 86 |
| 843. | TCTTCCCTTTCATCACAATACCTAC[T,C]GTCGTGCAAGACTTTAGGATTTTTT | 386,240 | 86 |
| 844. | ACTGCTCCATCAAATATCTGTAAG[T,C]TGACAATCTCAATGCCCTTGATCGC | 386,388 | 86 |
| 845. | AaGTAGATACCTCATCAATCACCA[A,G]AAGAACATTATCACTATCTTCTGTA | 386,557 | 86 |
| 846. | GCTATGGGCAATCTCTGACTCGAT[G,A]CCCCAACTCATCATACCTGTAACAC | 386,653 | 86 |
| 847. | CTATGGGCAATCTCTGACTCGATG[C,T]CCCAACTCATCATACCTGTAACACC | 386,654 | 86 |
| 848. | CCTGTAACACCTGATCTTGCTGTA[G,A]TCCCTCGATTTGGATTTGGACCGCC | 386,693 | 86 |
| 849. | GTCACTGCCATTGCCGAGTCATCA[T,C]CTGAACTCGAAGCTCAGTTCTTCCA | 386,790 | 86 |
| 850. | CTTCCATCTGAGAACCTCATTCTG[G,A]AGAAGTGTAGAAGTGACTTCTTTCA | 386,834 | 86 |
| 851. | AAAAACTCAAAaGGAAAAAAAaGT[A,G]ATGAAGGCAAGACCAATGCCTTGGT | 386,922 | 86 |
| 852. | TCAAAaGGAAAAAAAAGTAATGAA[G,A]GCAAGACCAATGCCTTGGTCTTCTC | 386,928 | 86 |
| 853. | GAAAGTTGCTGAGATGCTCCTGCA[T,C]GCTTTGTCCCTCACTCATCTGCAGC | 387,022 | 86 |
| 854. | CTGCAGCTGATAGAACTGCTTTCA[A,G]AGAAAGAGAGCGTTGGTGAGTGACT | 387,065 | 86 |
| 855. | CATCTCGAGCTTCATCCACATCGC[T,C]ATCGAAGAACTGTCGCTAAGCATAT | 387,125 | 86 |
| 856. | AAAAAaTAATACAAGAGGAGATC[A,G]CACACTTTCAACTCTCATAAACTTT | 387,637 | 86 |
| 857. | AGAACCCCTAAGTAGACCCTCTAC[A,G]GCTCCCTCTGCTTCACGGGTTGCTC | 387,730 | 86 |
| 858. | AAATTTTATCAGGACTACCCCCCa[T,C]GTCGACCATCCGATCATGACCGCA | 387,853 | 86 |
| 859. | AATTTTATCAGGACTCAAAAAaT[G,C]TCTGACCATCCGATCATGACCGCAA | 387,854 | 86 |
| 860. | ATGACCGCAAGCTCTCCTGACCCT[T,C]AGATCGTGCAAAACAATGCATGAAC | 387,894 | 86 |
| 861. | GCACTCGTCCGTGCGCACGTGAGC[C,A]GCAATAAACCCTCTGTAGACCGCCG | 388,012 | 86 |
| 862. | CACGTAGCCGCAATAAACCCTCT[G,A]TAGACCGCCGCAGTCCATGCGCGGC | 388,027 | 86 |
| 863. | CGTGCGCCTATGCGCGTGGGCCGC[A,G]CGCTGGATAGGTCGCCCACGCTGTG | 388,098 | 86 |
| 864. | TGGGTGCCTGCAAGCCGGGCCTAG[G,A]GGCTGCACCTGTAGGCCTAGTTCCT | 388,154 | 86 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 865. | GGCTACTTTGGGTCGAATTCGAGG[T,C]GCCAAAACTCAACAGCTTCATCATT | 388,238 | 86 |
| 866. | ATACCTACCATTAATCTAAAACCA[T,C]CAGTCTGGAAAGAAGAATTTGGAGG | 388,312 | 86 |
| 867. | TTGGAGGTCACCTTGAAGAAGGA[C,T]AATCAGAGGAATTGTTTGTTGATGT | 388,355 | 86 |
| 868. | GTGTGACTTTAGTGTGAACAGAAT[T,C]CAAGAGCATGTATAAATAAGGAAGA | 388,911 | 86 |
| 869. | GAGACCTTTGTGAGTCGCATGCAT[T,C]GCATGTCCCTGTCTAATAATTTGTG | 389,520 | 86 |
| 870. | AAATCTTGATTCATTGTTTTTGAT[T,C]TCTATAGATTTCTCCCTTTTTCTTT | 390,032 | 86 |
| 871. | AAAAAACACATAGGCTAGCTTATT[C,A]AAAAAGATCCAATTCAGTTCATGGA | 390,551 | 86 |
| 872. | GTAAAGGTTGCTAAGAAATCTGTC[G,A]AGACATTTGCTTGCCATCCATGATC | 391,234 | 86 |
| 873. | GTCTTCAGGATTGAGAACTTGATC[G,A]TCAATTGATGGTAATGTTATGGGTG | 392,029 | 86 |
| 874. | TCTGCATCTCATTCATTTCTCCCT[A,G]TCTGAACATATCTTTCTTCCGAAAG | 392,738 | 86 |
| 875. | AATCACTACTTTCTGTACCTGGTT[A,C]TTTTGCTGACAGTGACTCATGCACC | 392,985 | 86 |
| 876. | CTGTGATGCGGAACTAAGCATGAT[A,C]TATATGGCCCTTTCTGGCTTAAGCC | 393,847 | 86 |
| 877. | AATGATTGGGTAATGATGTTTTAC[T,A]TGCTTTTTGACGCCCATGCATCTGT | 394,038 | 86 |
| 878. | TGCTAGTGGGGTCTGCTTTGGC[G,A]CTTAAACATCAGAAGATAGACCAAA | 394,830 | 86 |
| 879. | TTTATCAGGGACCAGAGTAAATAA[C,T]ATAGGTACTAGTAGTGACAGAATAT | 395,132 | 86 |
| 880. | TTTCCTTACATAGGGATCAATCAT[C,T]GATGTTTTAGCTGATATCAGCCATT | 395,457 | 86 |
| 881. | GGTCAGCTTTACTGGGCAATGTTT[T,C]TCCCAGGGTATCTTTCATGTTTTTA | 396,342 | 86 |
| 882. | ACTAGTTACCATTTTTCACTATGT[G,A]AAATTGTCTCTCACTCTGCCAGCCT | 396,502 | 86 |
| 883. | GTCCTGGTCAATCGTGTCATTTTC[A,G]GTATGGCTGTAATCAGGTTCCATGA | 396,656 | 86 |
| 884. | TGGTTTCATTACTGAGACAAGTCT[G,C]TACTCACGAAAAAATGATGTGATTT | 397,285 | 86 |
| 885. | TTTTGTTAATGTTTTTGCCATGGA[G,A]ATTATGGAAATGGGTTAGGGAAGTT | 397,698 | 86 |
| 886. | CTTCATCTTGTTGCCTCTAGTATA[T,C]GCCTTTTTAATATCATTTAATCACT | 397,983 | 86 |
| 887. | ATGTATATATGTATATATGCATGC[A,G]TGCGTGCATGTGTGTACATATATAA | 398,096 | 86 |
| 888. | TATATGCATGCATGCGTGCATGTG[T,C]GTACATATATAATAGGATTGGACGG | 398,109 | 86 |
| 889. | AAAAATCACAGAAAAGCCCTCAAT[G,A]GAAAAACACTCTCTTTCCATTACAG | 398,180 | 86 |
| 890. | CTCTCTTTCCATTACAGGCCCAAC[T,A]CAAGTATGGCCTAACAAAAACTCTT | 398,213 | 86 |
| 891. | AGTTATGATTTCCTCATCCCTAGT[G,A]TAGCAAAACAAACTAGTAGAAACCT | 398,276 | 86 |
| 892. | AAACCTTGGGCAACGCATGAAATA[G,T]AGCCAAGAAATATAAGAACGTGTTT | 398,320 | 86 |
| 893. | AATTTGAATTATTTTGGTGGACAA[A,C]AATTAGAGAAGAGATGAGACTACTC | 398,447 | 86 |
| 894. | CACATGTTGTAAAGCAACTAAACA[T,A]AACTTTTCCAATATTTACAAAAGCA | 398,511 | 86 |
| 895. | CATGTCCAATGGGAGTATTTGGAC[A,G]GGGGTTAGCATCATCTGGCTGCCTG | 398,859 | 86 |
| 896. | TTGGACAGGGGTTAGCATCATCTG[G,A]CTGCCTGCATGTAAGTCAATATGTA | 398,877 | 86 |
| 897. | ATTACATAAACAATTATCATCAGC[A,G]GCAGCGCATCTTCTCATTCATGATA | 399,072 | 86 |
| 898. | TATTGAGATTCGTTATATTTATCG[A,G]GAGGTCAATAGCTCTATCGACTGGA | 399,146 | 86 |
| 899. | ATTTATCGAGAGGTCAATAGCTCT[A,G]CTGACTGGATGATCTTTTATGTGAC | 399,162 | 86 |
| 900. | AAAAAAaTAAAGTGACATGTGGCC[T,C]GGCACAAAGTCACGTGACCTTGAAT | 399,326 | 86 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 901. | TCCAACAAGCATTTTAGATTATAA[G,A]CTTACACCATGGGCGAGGGAAGTTT | 399,376 | 86 |
| 902. | TCTGGTCAATTTTATTAAAATGTA[T,C]TGTTCCAATATTAAAATTTTCTCGA | 400,348 | 86 |
| 903. | GTGTTCCTTTGATCTAAAAACAGT[C,A]TAATTTTTTGCTACCACAAATATAC | 400,418 | 86 |
| 904. | TTCTTTTACAGAAAAAACTCACGGA[C,G]AATAAGCTTAAATCTTCATGGCCAG | 400,605 | 86 |
| 905. | TATATCGATGGTCCCGGAGGAGTC[T,C]TGATTTAGTACATAACTTCTAAATG | 400,778 | 86 |
| 906. | ACATAGCATAGCATTTACCATAAA[G,A]AACCATGCATCGTTACGTCATCCAA | 401,047 | 86 |
| 907. | GAAGTCTTATGTATGCTTAaGTTTT[C,T]CCTTTAGAATACTTGGAAGGCTTGA | 401,812 | 86 |
| 908. | TGTTCATGCAATTAAGTTACCTTG[A,C]CATATGTGATGCATTAATTACATGC | 402,407 | 86 |
| 909. | GTGTAAATATTAATTGTTCTTATC[T,C]ATTATTGCTTTTCTTAGTGTTTTTC | 402,836 | 86 |
| 910. | CAATACCATAGGTATTTGTTCTTG[C,T]TAGCCATAAAAATATACAAGCATAT | 403,009 | 86 |
| 911. | GGTATTTGTTCTTGCTAGCCATAA[A,C]AATATACAAGCATATGAGGGTAGCA | 403,019 | 86 |
| 912. | TGGTGATGATGTTATCCATAACCT[T,A]ATCAATAATTTGGTTTTGATTTTCT | 403,130 | 86 |
| 913. | ATGTACGTGGGTAGAAGGGACAGC[G,T]TTAACATGAAACATGTGGAAGTTTT | 403,562 | 86 |
| 914. | CTATTTATAGATGAAAGAAATGAA[A,T]AGAAAGAAAAaCTTTAAAAGAAaGA | 403,675 | 86 |
| 915. | TTATAGATGAAAGAAATGAAAAGA[A,C]AGAAAAaCTTTAAAAGAAaGAAAAA | 403,679 | 86 |
| 916. | AAAAAaCTTTAAAATACACCGCA[C,T]GATTAATTTCTTATTCACCATGTCA | 403,725 | 86 |
| 917. | AATACACCGCAACGATTAATTTCT[T,C]ATTCACCATGTCACCTCTTCTATGA | 403,737 | 86 |
| 918. | ACATTTTATATCGAAGATATAGTA[G,A]CACAAACTCCATCCGGCGGTACAGC | 404,131 | 86 |
| 919. | CTCTTAAGAGGAAACCCACATAT[C,T]CGATGCCAATTGCATGCAGTGGAAA | 404,204 | 86 |
| 920. | GCTCCCTTCTTTTCCCTCGGAATT[T,C]GCGGTGTTGGACTTCACCTTCTCTT | 404,277 | 86 |
| 921. | TATCCATTTGTCATGATCTTGTCT[C,A]ATGAATATATGTATTCTGTTCTTGT | 404,924 | 86 |
| 922. | TCTGCAAACGCCGAAATGGACTGC[T,C]GAAGAATGCTTATGAGTTGTCTGTC | 405,325 | 100 |
| 923. | ACGCCGAAATGGACTGCTGAAGAA[T,A]GCTTATGAGTTGTCTGTCCTTTGTG | 405,332 | 100 |
| 924. | AGAATGTTAATGATGGTAGTTTTG[C,G]TCCTCTTCAATTTATTTGCTTCCCT | 405,543 | 100 |
| 925. | CTCCCACCCTGTGCAACTAATTCC[G,C]ACAAAATAAGGGTCTCCATTGTTA | 406,358 | 100 |
| 926. | TGTGCCTCATGACGAGCATTACCT[T,A]TCCATGGTTCTGACACGACATTGA | 407,199 | 100 |
| 927. | CATGGTTCTGACACGACATTGCAT[A,C]CTAGATTTTACTGTGTACGTAAAAA | 407,226 | 100 |
| 928. | ACACGACATTGCATACTAGATTTT[A,T]CTGTGTACGTAAAAAAGCACTGCAT | 407,236 | 100 |
| 929. | GGACTAAGTTTAAACATATAAAAA[T,C]ATTTAAATTTTGAAATATATATGTA | 407,845 | 100 |
| 930. | AATGGATTGGGTCTGGTTGGGTCA[A,G]TGCGAGTCTGCTTTAAATATATATAT | 407,944 | 100 |
| 931. | AATATATATATACATATGGGCATG[G,A]TCAAATCAGGTTAGTTTATATATAT | 407,983 | 100 |
| 932. | CAAAATTTTTGCAAGCATTCAAGT[G,A]GACACAAATCAAGGGCACTAATGC | 408,312 | 86 |
| 933. | TAAAAATAGCATGCATTTTATGAA[G,T]ATAACCTTACTATTATTAGGTAATA | 408,455 | 100 |
| 934. | CGAGATGGAGAGAAAGCACTTCAT[C,T]TCTCATCTTTCCTCTCTAAATAACA | 408,567 | 100 |
| 935. | AGAAAGCACTTCATCTCTCATCTT[T,C]CCTCTCTAAATAACATTTCACTAAG | 408,577 | 100 |
| 936. | TACCATTTCTCATAGAAAAAAAa[C,T]ATTATCTAAGAAGAATAAATTATTA | 408,694 | 100 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 937. | CTTGTTGCTATTATAAACCCATG[A,T]CAACAATCAATATGCACTAAAGTTT | 408,807 | 100 |
| 938. | GAAAGTAAGGAAAATTGCTTGAA[G,A]ATTTAGAAGTGCATAAATATAATCT | 408,992 | 100 |
| 939. | GAGGAGTCTTATTTATATTTTGAG[A,G]ATTAGAAAGGGGGAGAAAATTGAAC | 409,048 | 100 |
| 940. | GAACAAAACTTTGATAAATTGATT[G,A]TAAGAATTTTCAAACCTTAAAGCGA | 409,094 | 100 |
| 941. | AAGGTTATCTATATTCATTAATAT[C,T]AtTTTTTAAATTATTGTATATATT | 409,187 | 100 |
| 942. | TTCTTTAAAAGTTAGATTGGTTTC[G,A]TATCCATCATAAATGATAAATGATC | 409,256 | 100 |
| 943. | CTTTAAAAGTTAGATTGGTTTCGT[A,C]CTTATCATAAATGATAAATGATCTG | 409,258 | 100 |
| 944. | AAAATTATTTGACATATAACCTTT[G,T]ATAAGAAATTACATATTAGGATTTT | 409,319 | 100 |
| 945. | ATATTAGGATTTTATGGTTTACTG[T,C]CATATAGTTCTTTGTTTTGTATTTA | 409,356 | 100 |
| 946. | TGATGGCTTATGATTTTtATTTTT[T,C]ATAACATTTATTTTTATCTATAATA | 409,471 | 100 |
| 947. | TTAATGAAAGTGGATTACACGACA[T,C]CTAACTTATATTTTTGAAAATAGAG | 409,536 | 100 |
| 948. | tTTTTAAAATTTAAATGTCATAGG[T,G]TTGAAAAATTCTTACTTGTAAATAT | 409,702 | 100 |
| 949. | ACACTTAGATTGTGATTGTTGTTT[G,A]GCATTGGAAGATCGAGACAATTAAT | 410,005 | 100 |
| 950. | TTAATACCATAAGTGGGATATATA[C,G]TTGCTTAACCCAACATTAAACCAAA | 410,050 | 100 |
| 951. | ATACTTGCTTAACCCAACATTAAA[C,T]CAAAATCACCTCTCGACAATCACAC | 410,071 | 100 |
| 952. | GTGTACTCAAGATAAACATGGATT[G,A]TCAAGATATATATAAGAATAATAAA | 410,129 | 100 |
| 953. | TTTGTTTTTAATTTAATCCTTGT[C,T]TTCTTAAATGACTCAGCTTGTAATT | 410,291 | 100 |
| 954. | ATCCTTTGTCTTCTTAAATGACTC[A,G]GCTTGTAATTTAAATATATCATTAC | 410,306 | 100 |
| 955. | GCAGTAATGTCCATTTGTTGTAAA[T,C]AATATTTGGCAATAGAAAGAAATAC | 410,360 | 100 |
| 956. | CCATTTGTTGTAAATAAATATTTG[G,A]CAATAGAAGAAATACTATAAGGTCA | 410,370 | 100 |
| 957. | TTTCGTATAGTCTATTATAAATGT[A,C]GAATGAAACATAATAGGCTTTTCAT | 410,446 | 100 |
| 958. | AATTATCAAATATCAAAATTAATG[T,C]ACCAATTTTGAGACATCAATATTA | 410,515 | 100 |
| 959. | AGACATCAATATTATAAAGGGATA[C,T]AAGAAACTAACGAGAGTACACTGA | 410,551 | 100 |
| 960. | CTAAGAAACTAACGAGAGTACACT[G,A]ATCAAGAAATGTGATCGACCAGTGA | 410,575 | 100 |
| 961. | ATCGACCAGTGAGGCATGTTGTTT[A,G]TAAATTAATTAGACACGTTTTCAAT | 410,613 | 100 |
| 962. | GAGGCATTGATAAATGGATCACT[C,T]GAAATAAAATTAAGAAAGAATGAG | 410,623 | 100 |
| 963. | TTTATAATTGATAAATGGATCACT[T,A]TTTATTTGCTCTTTATATTTAGACT | 410,686 | 100 |
| 964. | ATTTTCATTACCATAAAaAAAGAT[C,T]GAAAATAAAATTAAGAAAGAATGAG | 410,805 | 100 |
| 965. | GATAAGTTTGATAATTTTAGACAT[C,T]CGCTTGCATAATATGGCATGTTTAA | 410,854 | 100 |
| 966. | TTCATGTTTAATATTAATTTATCA[C,T]GAGAATGCAAAATATATAAAATT | 410,893 | 100 |
| 967. | TTAATTTATCACTGAGAATGCAAA[A,C]ATATATAAATTTTTAATTAAGCTT | 410,906 | 100 |
| 968. | AAATAATAATTAAACTAAGAAAA[T,C]AAAAAATATTTAATAACAATTGGAA | 411,066 | 100 |
| 969. | AATGCATGGAATGATTTCATAAA[G,A]TTGCATTGTACTAAAAGAATTTATG | 411,249 | 100 |
| 970. | TTAATTATACTTTACAATAGTAAAC[T,A]ACCTTTTGAGCAAAATGGTGGTAAC | 411,330 | 100 |
| 971. | TTATACTTTACAATAGTAAACTAC[C,T]TTTTGAGCAAAATGGTAACCCA | 411,333 | 100 |
| 972. | CTAGATAAAGAAGGGGACAGAAA[G,A]AGAGATATAGGGCTCCCGAGCTTAA | 411,422 | 100 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 973. | GATAAAGAAGGGGGACAGAAAGAG[A,G]GATATAGGGCTCCCGAGCTTAAGCA | 411,425 | 100 |
| 974. | AAGAGAGATATATAGGGCTCCCGAGC[T,C]TAAGCAACCAAGCAATTCAATATAG | 411,444 | 100 |
| 975. | CCGAGCTTAAGCAACCAAGCAATT[C,T]AATATAGTTGCAACCAATAAAATCC | 411,462 | 100 |
| 976. | AATATAGTTGCAACCAATAAAATC[C,T]GATATGAGCAATATAAATATAACT | 411,487 | 100 |
| 977. | AATATAAATATAACTCACTAAAAG[C,T]CCAAATACACCCAATAAGCCAGG | 411,522 | 100 |
| 978. | AAAGCCCAAAATACACCCAATAAG[C,G]CCAGGTAACCACTAGCCCAAACATA | 411,542 | 100 |
| 979. | CCTCTACCTTCCAAGCTCTAATTA[T,C]TTTAATGCCATTGCAAATCATCATG | 411,642 | 100 |
| 980. | TCTTCTTCTAATTTGGTGTACTAT[C,T]ATTTTCAATGTATTGCAACTCTATT | 411,697 | 100 |
| 981. | TCTAATTTGGTGTACTATCATTTTT[C,T]AATGTATTGCAACTCTATTGCCAAT | 411,703 | 100 |
| 982. | TTGCCAATCGATGCTCCTCCAAGG[C,T]ATCTCTCAAGATCTCATTTGGCTCT | 411,745 | 100 |
| 983. | TCAAGATCTCATTTGGCTCTTAG[C,T]GCTACCACTACCATCCATCCTATTA | 411,775 | 100 |
| 984. | TCTAGATCAATATCAAAATTAATG[C,T]AGCTCTTTTCTCGATACTTTTTGCA | 411,828 | 100 |
| 985. | TCAATGTCCATGCCCATCTTCCAT[G,A]AAAGCTACTTGGCAAACAATCCTAA | 411,978 | 100 |
| 986. | GAAAGCTACTTGGCAAACAATCCT[A,C]ATAGGTTCCAAAAAACCCCACAGCT | 412,002 | 100 |
| 987. | AACCCCACAGCTAAGGACTAAACA[C,T]ACAACCACACGGTTCTCTTATACT | 412,040 | 100 |
| 988. | CTAAACACACAACCACACAGGTC[T,A]CTTATACTCTCTTTATTTAGATTCA | 412,057 | 100 |
| 989. | TCTAGTCAACTGAATCATAACA[T,C]CATAATCAATCCATGGTCAACTCCA | 412,135 | 100 |
| 990. | TGGTCAACTCCAACCATTTATGAA[G,A]CATAAAGATCTTATCTAAAAAAaTC | 412,173 | 100 |
| 991. | ATCAATAAAATACATGCTTGTGC[G,A]GAGATCCTCACAAAAATATTTAGCA | 412,292 | 100 |
| 992. | TCAAATAAAATACATGCTTGTGCG[G,A]AGATCCTCACAAAAATATTTAGCAA | 412,293 | 100 |
| 993. | CAAAAATTAAAAGTATAAGATGAA[T,C]ATAGAATTGATGAATAAAGAACCAA | 412,485 | 100 |
| 994. | ATTGATGAATAAAGAACCAAAAAA[T,C]ATACTGAACTAAAAGAGAGAGTATG | 412,515 | 100 |
| 995. | AAGGTAGAAACCCCACTATGGTAT[G,A]TATAACATAAGAAAGACCGTTATTA | 412,585 | 100 |
| 996. | TCTTAGCTAGCTACTTTAAGGATA[C,T]AACTTTTACACATTCACTCACAAAT | 412,682 | 100 |
| 997. | TTACACATTCACTCACAAATCCTA[G,A]AGATTTAGCAAAAGAGAAAAGAGAG | 412,712 | 100 |
| 998. | GAAAGGCAAGGGAAGAATAGTTCC[T,C]ATAATAGAATTTTCACTAGTTAATA | 412,771 | 100 |
| 999. | TTTGTAGGTAATATATAGGAACTC[A,T]ATTCTTAAACTTTTCAATGTGGGAT | 412,867 | 100 |
| 1000. | TTGTAGGTAATATATAGGAACTCA[A,T]TTCTTAAACTTTTCAATGTGGGGATT | 412,868 | 100 |
| 1001. | AACTTTTCAAAATTTATTAATATC[A,C]AACTCTCCTAACTTAGACAAAAAAT | 413,004 | 100 |
| 1002. | CCATTTTATCTAGATTTAAGATG[C,A]ATAACTTGAATGATAAGATTTTAAC | 413,534 | 100 |
| 1003. | TCATAAAAGGTGGTAATCAAGTCA[T,C]ATTATATTTATCAAAGCACTGTCTA | 413,631 | 100 |
| 1004. | TTTTAAAATTTAGTGAGATGGTTG[C,T]ATTGCCTCCATCTATGACTTAAATT | 413,742 | 4100 |
| 1005. | TTTAGTGAGATGGTTGCATTGCCT[C,T]CATCTATGAGTTAAATTTTTGGATA | 413,750 | 100 |
| 1006. | TTGCATTGCCTCCATCTATGACTT[TA,A]AATTTTGGATAACAAAGCCATATC | 413,763 | 100 |
| 1007. | GGTTAGAAAATGTTACTAAAGGTG[A,G]TTTCATATGATTCTTAATGTCTAAA | 413,891 | 100 |
| 1008. | TTCTTAATGTCTAAAATAGTGTTT[A,G]ACTTTCTTTTCTCTATTTTAGTAA | 413,926 | 100 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 1009. | CTATTTTTAGTAACCAATGTCAAC[A,G]ACCTTAATGAAGCACTTGAAAAGAT | 413,963 | 100 |
| 1010. | TATTGATAACTAATTGTTACTTCA[G,A]TAACTCATCAAACTATTTTAATAA | 414,062 | 100 |
| 1011. | AATGCAACATGATATATCAATATG[C,T]TTTTCTATTAGACAATTCAACTTCT | 414,145 | 100 |
| 1012. | AGAGATTAATTCTCAAGTAAGAAA[G,A]ACATGGCAATTTAATCTAAAATAGA | 414,336 | 100 |
| 1013. | TAATTCTCAAGTAAGAAAGACATG[G,A]CAATTTAATCTAAAATAGATTTCTC | 414,342 | 100 |
| 1014. | CCATATATTTTTGCCTCATATGCT[T,C]ATCAGTTAAAATTCTTCATGCTCAT | 414,398 | 100 |
| 1015. | ATCTTTTTGTTGTTTGTTCATAGC[C,]TTACATGTATCTTTGAATATTTTGT | 414,488 | 100 |
| 1016. | TGGTTTACAACCTTTCTTTGAGAG[T,C]TGTAAGGGTGTAAAGGGCTAGAGCT | 414,635 | 100 |
| 1017. | GTCATTCCTTATAATGTAAGAGGT[A,G]ATGAAAAGATTTTCTTGCAAATTA | 414,769 | 100 |
| 1018. | CATTCCTTATAATGTAAGAGGTAA[T,C]GAAAAGATTTTCTTGCAAATTAGA | 414,771 | 100 |
| 1019. | CCATAATTGCTTTTCCTCTATTTT[C,T]TTTTTTtCATTAATCCCATATTAGTTC | 414,924 | 100 |
| 1020. | ATATTGTTATGGTGTAGGAGGGA[A,G]GGTATCATTAATCCCATATTAGTTG | 414,967 | 100 |
| 1021. | CTATGAGCCAAAACGGACAATACG[T,A]AATAGCCGAGCCATGAGCTCTTGGT | 415,102 | 100 |
| 1022. | ATACGTAATAGCCGAGCCATGAGC[T,C]CTTGGTTGCAACAGTGGCACACTAG | 415,121 | 100 |
| 1023. | CGAGCCATGAGCTCTTGGTTGCAA[C,T]AGTGGCACACTAGGAAAGGAATCAC | 415,133 | 100 |
| 1024. | ACACAAACTCCTTGACTGGAGGGC[G,A]GTAATAAAAATAAAGATGATGGTACC | 415,213 | 100 |
| 1025. | TGGAGGGCGGTAATAAAATAAAGA[T,G]GATGGTACCTTCCGTCTATCCATAG | 415,229 | 100 |
| 1026. | CAAAAACGGACAATACTTCACATG[C,T]CAAGCCATGAGCTCTTAATCATAAT | 415,451 | 100 |
| 1027. | AGCCATGAGCTCTTAATCATAATA[G,A]TGGAGGGAGGGCATCATTAGTCTCA | 415,478 | 100 |
| 1028. | GGAGGGAGGGCATCATTAGTCTCA[T,C]ATTGGTTGTAAATCAAAGAAGATCC | 415,504 | 100 |
| 1029. | TCATAGTGGCTAAAGATCGAAACT[A,G]ATAATACATCACATATGCGGGAGTG | 415,878 | 100 |
| 1030. | TCATGATTTGTAGTGAGCATTCAT[C,G]TACTATTTTTTtCCAGAACTCATT | 415,973 | 100 |
| 1031. | ATTTATCTCAATTTTCATGTTTTA[A,G]AAGAAGGATAGATCTTGCCCAATAA | 416,026 | 100 |
| 1032. | ATTTATGAAAGTCCTATGAAAGCC[T,C]TATTGTAGTCAGAAAACAAGGTCAA | 416,086 | 100 |
| 1033. | GTCTATGGTTGAGAACTTCAACCA[A,C]TTGACTACGTTGCCTGAATGTTCAA | 416,148 | 100 |
| 1034. | TTATGATAGCAACTCTTCAAAAAa[C,T]CAAAAaTTGTGATGACAAACTGTTGC | 416,327 | 100 |
| 1035. | CAACTCTTCAAAAAaCCAAAAaTT[G,A]TGATGACAACTGTTGCCTAGGCGAC | 416,336 | 100 |
| 1036. | AAaTTGTGATGACAACTGTTGCCT[A,G]GGCGACATGTAAGTGGTTAAGATTG | 4165,355 | 100 |
| 1037. | CTAAAGTAGATGTTGAATCATAGG[C,T]GAACAATACTACTGAACAATACATA | 416,497 | 100 |
| 1038. | GAACAATACTACTGAACAATACAT[A,G]TTTCTTGCATACATTGGCTTGACTA | 416,522 | 100 |
| 1039. | ATACATTGGCTTGACTATTAGTGC[T,C]ATGCACTCTAGGTTCATTTATACTT | 416,555 | 100 |
| 1040. | ATTAGTGCTATGCACTCTAGGTTC[A,G]TTTATACTTCACAAGAGTTTTTATT | 416,571 | 100 |
| 1041. | TGAATAAGAGTTAAGTAAAAGGAC[C,G]TAATTATCATAAGCTATGGAAGACA | 416,673 | 100 |
| 1042. | ATGGAAGACAAGACAAGGGATACT[G,A]CCATTGATACTCTTAGTAAAATAGT | 416,713 | 100 |
| 1043. | CTGCCATTGATACTCTTAGTAAAA[T,A]AGTGTTATAAGTGATAGTAATAGCA | 416,735 | 100 |
| 1044. | GAAATGCATACAAGTTGCGGTATC[A,C]TTTGTGAAAGAGAAAGTATTTTCTT | 416,831 | 100 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 1045. | CATTTGTGAAAGAGAAAGTATTTT[C,T]TTTTATTTACGTTTAGTCAAAACCA | 416,854 | 100 |
| 1046. | GAAAGAGAAAGTATTTTCTTTTAT[T,C]TACGTTTAGTCAAAACCATATTTAT | 416,861 | 100 |
| 1047. | ATTTGCCATTATACCGCCATTGGT[A,T]AGAACAAAATGCCCTCAATACCAAA | 416,974 | 100 |
| 1048. | CATTATACCGCCATTGGTAAGAAC[A,G]AAATGCCCTCAATACCAAAATAAAC | 416,980 | 100 |
| 1049. | AAATGCCCTCAATACCAAAATAAA[C,T]TGCATTTGCAAGTTATTTGAAAGAA | 417,005 | 100 |
| 1050. | TTGAAAGAAGTGCAACTCTATTAT[T,C]GTGGCATGTTAACGAGCTTTTCTAT | 417,046 | 100 |
| 1051. | CTATGATGGTTATCAAATTGTATA[A,G]CGAAGGCAAAAAACTATGGCTAAAT | 417,117 | 100 |
| 1052. | CAAGGCTCTAAAGAATATACAAAG[T,C]CTTAACTTCTTTACATCCTCAAAAT | 417,330 | 100 |
| 1053. | CTCAAGTATCTGATTGGTGTTGAT[A,G]ATGCTCCATCTAATTAATTCCTTCA | 417,475 | 100 |
| 1054. | CCAAAATACATATATCCTATGAC[T,C]CTTAAAAAGAAAaGGAAAAGAGGAG | 417,526 | 100 |
| 1055. | GATGTAAGCTTTACAATCCAATAA[G,A]AATTTTCACACACCAACACTAATAT | 417,575 | 100 |
| 1056. | GCTTTACAATCCAATAAGAATTTT[C,T]ACACACCAACACTAATATAATAATA | 417,582 | 100 |
| 1057. | TAATAATAATAAATAaAAATAAG[T,C]AATAGTTGTTACTCTTATAAGTCTT | 417,624 | 100 |
| 1058. | ATAATAAAACATGCAAAGAAAGTA[C,T]ATCTTTTTATATAATAAATCATATT | 417,692 | 100 |
| 1059. | CACTGAACTATCACAATCATGTTT[C,A]TGGCTCATGGCAAGATATCGACATA | 417,795 | 100 |
| 1060. | CTGGCTCATGGCAAGATATCGACA[T,C]AGTGGCTAGTCTCCTAAACTATCAC | 417,819 | 100 |
| 1061. | TCTAAACTATCATAATCACATTTT[C,T]AGATTACGGTAAGGATCAATATAGT | 418,017 | 100 |
| 1062. | AAACTATCATAATCACATTTTCAG[A,T]TTACGGTAAGGATCAATATAGTGGC | 418,020 | 100 |
| 1063. | CGGTAAGGATCAATATAGTGGCTT[A,T]TCACACAGACTACCACAACTATATT | 418,048 | 100 |
| 1064. | ACACAGACTACCACAACTATATTT[C,T]CAGCTTGTGGTGGGGCATCAACAAT | 418,075 | 100 |
| 1065. | CAGCTTGTGGTGGGGCATCAACAA[T,C]ATTAATAGCCTAAAGCACCACAACC | 418,100 | 100 |
| 1066. | CATCAACAATATTAATAGCCTAAA[G,A]CACCACAACCCACTATTCAGTTACA | 418,115 | 100 |
| 1067. | ATAACTTCATACAGATCTCTCTCT[A,C]TATATATGTATGTATATATGTATGT | 418,260 | 100 |
| 1068. | ATGTATGTATATATGTATGTGTGT[T,G]TGTATACATACAATTAACAAATAAG | 418,290 | 100 |
| 1069. | ATACATACAATTAACAAATAAGCA[C,T]ATAGCATGCAACTATCAAAAATCAT | 418,318 | 100 |
| 1070. | CATATAAATCAAAATCACTATGCA[C,T]AAAATAATTGTTATATAAATAGATG | 418,365 | 100 |
| 1071. | ATATAAATAGATGATCAATGTCTA[G,C]AAATTTTCGCTCTACGTACTGATG | 418,402 | 100 |
| 1072. | CTAGAAATTTTTCGCTCTACGTAC[T,C]GATGACAAACTTGGTTATAACTATT | 418,423 | 100 |
| 1073. | GTCCATGCCTAGCATGTCCAATCA[A,G]TCAATATAATTTCAGTTCATCCTGA | 418,478 | 100 |
| 1074. | CAATCAATCAATATAATTTCAGTT[C,T]ATCCTGAATCAACCATTAGCATAAA | 418,496 | 100 |
| 1075. | CATAAAAATTAAATAACTTATTGT[C,T]AGTGTTTTAATTTCAAAGCTCTAAT | 418,540 | 100 |
| 1076. | AACTTATTGCCAGTGTTTTAATTT[C,T]AAAGCTCTAATATTCGAATTAATCT | 418,554 | 100 |
| 1077. | TCTATACTTTCTAATTAAAAATTA[C,T]ATAATTAAATAAAAAATTTGGATTT | 418,617 | 100 |
| 1078. | TTACATAATTAAATAAAAAATTTG[G,A]ATTTTATCTTGACTATAAACTAGAG | 418,638 | 100 |
| 1079. | GCATAAAATCCCTTGCTCAGTATT[T,C]CTTAATTGGATGATTGGTCCCATCC | 418,687 | 100 |
| 1080. | TCTTAATTGGATGATTGGTCCCAT[C,A]CAAAATCAAAATCAATAATTAGAAA | 418,711 | 100 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 1081. | CATAAAATGGTTATCATCGATGGT[A,G]GAAAATTTAGAAGAAGAATATAGCT | 418,765 | 100 |
| 1082. | GGCAATGCTAGTAGCATCCAGTGA[C,T]TAGTGTTAGCCCAATATACATAATC | 418,943 | 100 |
| 1083. | TAGGAATTTGGTGATGATAAAATC[A,C]AACAATGCTTAGCAGGGTCGGGTTT | 419,035 | 100 |
| 1084. | AGGGTCGGGTTTGGAGTTAACTAT[T,C]ATACAGAACAAGTCCAAAACCTTCT | 419,073 | 100 |
| 1085. | AAACCTTCTTCTAGGATCAACATA[G,A]GGTCTACTATCAAGTCTTCAAAATC | 419,114 | 100 |
| 1086. | TATAAGAAGAGAGAGAAAAAGATA[G,T]AGGAAGAAAGCTGGTAGAAAGAGAT | 419,194 | 100 |
| 1087. | GAGAAGGGAGAAAAAaaGAACAAA[C,T]CAAATCTCTCTCTTTCTCTCTTCAT | 419,250 | 100 |
| 1088. | TTTCTTCAAAAAGGGGATTTTCCC[C,T]TTTCTCCCTCTCTTTCTCCTAGCGG | 419,307 | 100 |
| 1089. | GATTTTCCCCTTTCTCCCTCTCTTT[T,C]CTCCTAGCGGATGGCTAAGGCCAGC | 419,322 | 100 |
| 1090. | CCTAGCGGATGGCTAAGGCCAGCA[G,A]TCTATGGTGGTGTCTAGTGGTGAAG | 419,349 | 100 |
| 1091. | TGGTGGTGTCTAGTGGTGAAGATG[C,T]TATGGCCGCAGTGCTACAGCGATGG | 419,378 | 100 |
| 1092. | CGGTTGGTAGTGGTAGTGGGCGAT[C,G]CAATAGAAAGAAAAGGAAATCAAAA | 419,435 | 100 |
| 1093. | TTGATATGATAAGAAGACTACAAG[G,A]TGGTCAGCGGTAATGACAAGCATCC | 419,509 | 100 |
| 1094. | GTGGTCAGCGGTAATGACAAGCATT[C,T]CGCATTAGCTTAACCTCTTATGATA | 419,533 | 100 |
| 1095. | GCATTAGCTTAACCTCTTATGATA[G,A]TTGCAAAGGCAATAATAGCCACAGT | 419,559 | 100 |
| 1096. | AGAAGGTCCTTAGTGCGGCAACAT[C,T]CGACGGTCTTCCAAGAAGATTTCAG | 419,637 | 100 |
| 1097. | GTCCTTAGTGCGGCAACATCCGAC[G,A]GTCTTCCAAGAAGATTTCAGCCAAT | 419,642 | 100 |
| 1098. | TCTTCCAAGAAGATTTCAGCCAAT[G,A]ATGGCTGTATGAAAATAaAAAaGAA | 419,668 | 100 |
| 1099. | ATAaAAAaGAAaAAAaGGTACCAA[T,C]AAGATGGGAGGCCACGATGCCTCGA | 419,707 | 100 |
| 1100. | GGTACCAATAAGATGGGAGGCCAC[G,A]ATGCCTCGATCATCTCTAATGATGG | 419,723 | 100 |
| 1101. | ATACAGTGGAAGCTTGGCTTTATA[A,G]ATGATGGAGGCTAGGGTTTTCTAGC | 419,843 | 100 |
| 1102. | AATGATGGAGGCTAGGGTTTTCTA[G,A]CCTCCGATGAGTTGGAGAAGGAGCC | 419,867 | 100 |
| 1103. | CCTCCGATGAGTTGGAGAAGGAGC[C,T]AGAGTCAAACTCTTTCTTCGACTCA | 419,892 | 100 |
| 1104. | TTTCTTCGACTCAAATAGGGGAAG[G,A]GAAGGTCTTTCCTTCCTTCCCATTG | 419,929 | 100 |
| 1105. | TTCGACTCAAATAGGGGAAGGGAA[G,A]GTCTTTCCTTCCTTCCCATTGTTTC | 419,933 | 100 |
| 1106. | TTTCAAGCCTCTACAACCATATGA[A,C]ATCATAATGTCAAAGCTAGAAAAGG | 420,015 | 100 |
| 1107. | ACAACCATATGAAATCATAATGTC[A,G]AAGCTAGAAAAGGAGATCTATGCCA | 420,027 | 100 |
| 1108. | AAAGGAGATCTATGCCATAATATT[C,T]CAATTCCAAGCCTAATCAAAGAACC | 420,060 | 100 |
| 1109. | GATACCTAAGTTCTCCCTAGCATT[A,G]TCTATGGTAAGAAAATCTATTAATT | 420,135 | 100 |
| 1110. | CTAGCATTATCTATGGTAAGAAAA[T,C]CTATTAATTAAAATTGCATAATTAT | 420,151 | 100 |
| 1111. | AAGAAAATCTATTAATTAAAATTG[C,A]ATAATTATATCTAAATCAGTCAAAG | 420,168 | 100 |
| 1112. | TCTCTCTTTCTTTATCAAAATTAT[A,C]CTCCTTTACCAGGAAACTAATTCGA | 420,230 | 100 |
| 1113. | ATCTTTTGGATCAAAGAATTAATG[T,C]ATTTAATTAGTTTCAAAATAACTCA | 420,292 | 100 |
| 1114. | TAATCTAAATCCATCGATTCCTCT[G,A]GGTTGACTAGGTGAATTCTAACAAA | 420,368 | 100 |
| 1115. | TTCTAACAAAATACCGCTTAATAT[C,T]GGAACCAAGAAGATCCAAAATTTTA | 420,408 | 100 |
| 1116. | TTAAATTAATCCTGACTTCTCTAA[C,T]AGTTGAATTAGACTATCAAGATCAC | 420,611 | 100 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 1117. | TTAATCCTGACTTCTCTAACAGTT[C,T]AATTAGACTATCAAGATCACCTTTT | 420,616 | 100 |
| 1118. | ACTTCTCTAACAGTTCAATTAGAC[T,A]ATCAAGATCACCTTTTCTCTTGGAA | 420,625 | 100 |
| 1119. | TTCTAACAAGTTAGAAAACTCTAA[A,G]TCAACATTCTTATTAACTTGTTTAT | 420,688 | 100 |
| 1120. | TTCACTACAATTCTTAGTATCAAT[C,T]GACAAACCACATGAACGCCCCTTAT | 420,754 | 100 |
| 1121. | CACATGAACGCCCCTTATATGTTA[G,A]ACATATACAAGTCCACCAGAATCAA | 420,786 | 100 |
| 1122. | TAGACATATACAAGTCCACCAGAA[T,C]CAATTTCTCTACTCAATTAAATATC | 420,808 | 100 |
| 1123. | ATAGCAAGATACTATAGACCTGCT[C,T]ATAAGCCTAACTCTGATTAGAATTT | 420,859 | 100 |
| 1124. | ATAGACCTGCTCATAAGCCTAACT[C,T]TTGATTAGAATTTAACACATCCAACT | 420,872 | 100 |
| 1125. | GATAATTTAAATTATCAAAGATTC[T,C]ACCAAGATGCATATCTCATATCCAA | 420,967 | 100 |
| 1126. | AATTTAAATTATCAAAGATTCTAC[C,T]AAGATGCATATCTCATATCCAATTG | 420,970 | 100 |
| 1127. | TCTACCAAGATGCATATCTCATAT[C,T]CAATTGATAAAATCTAATCCATTAA | 420,989 | 100 |
| 1128. | TGATCTTCTTATAGGTTTGATTCT[C,T]GAAGAATGTTTATTTTAACACTAT | 421,081 | 100 |
| 1129. | TTATAGGTTTGATTCTCGAAGAAT[G,A]TTTATTTTAACACTATGTAATTCT | 421,089 | 100 |
| 1130. | CCTAAACAACTTGCTAGTAAAGTC[T,C]AAAATTTTAATGATCAAACAATTAA | 421,153 | 100 |
| 1131. | ATATTAAGTTTAGAATTTCAAAAA[T,C]ATCTAAGTGACAATTGAGCAAGTAC | 421,238 | 100 |
| 1132. | GTGACAATTGAGCAAGTACACACA[G,A]CATAACACAATCTACCAATATATCA | 421,269 | 100 |
| 1133. | ATACTTAGGTCAAATCTTACTTAT[T,C]GAAATTAGAGACATAACTTATCCAT | 421,346 | 100 |
| 1134. | AATCTTACTTATTGAAATTAGAGA[C,T]ATAACTTATCCATTCCTTTTGTACT | 421,358 | 100 |
| 1135. | CTTTTGTACTCATAATATGCCAAG[T,C]CTTATGCATAAATTTTTATCATAAT | 421,398 | 100 |
| 1136. | TATTTCTACTATGTACATTACATC[C,T]CTAGTGATCACAACTTTAAGTTCAA | 421,479 | 100 |
| 1137. | AAATATCAATTAAGTTATAATCCC[T,A]AATAATCATAACCTAGCTCTGACAC | 421,527 | 100 |
| 1138. | ATGATGGCCGTATACTTTCTAGGA[C,T]AAGATCCTAAAGAATATGCAAGATT | 421,617 | 100 |
| 1139. | CCGTATACTTTCTAGGACAAGATC[C,T]TAAAGAATATGCAAGATTTTAAATT | 421,624 | 100 |
| 1140. | ATGAATATTACACATTAACAAATA[C,T]CAAACCTTGTATAATTTATAAAATT | 421,720 | 100 |
| 1141. | GATCATCTGATTGGTATTGATGAT[A,G]TTCCATCTAATCAATTCTTTCAACC | 421,771 | 100 |
| 1142. | CAGATCCTATAATATTTAGGTGCT[A,G]GGCTCTAAATTATTACAACTATATT | 422,069 | 100 |
| 1143. | GTGGACTATCACAATCACATTTTT[A,G]GCATGAGGTTGGACATAAGCATAGT | 422,158 | 100 |
| 1144. | TCACATTTTTAGCATGAGGTTGGA[C,T]ATAAGCATAGTGGCTAATCTAGAGG | 422,172 | 100 |
| 1145. | ATAAGCATAGTGGCTAATCTAGAG[G,A]GTCATAAGTGCTCAACTCTGACTAC | 422,197 | 100 |
| 1146. | ATTGGGATATCAATAAAATGGCTA[G,A]TTCAGAAAACTACAAGTACTCAACT | 422,269 | 100 |
| 1147. | GGGATATCAATAAAATGGCTAGTT[C,T]AGAAAACTACAAGTACTCAACTCTA | 422,272 | 100 |
| 1148. | CAAAATAGCAAGCCTAGAGCACCA[C,T]AATCCACCATTCAAGGACACAATTC | 422,362 | 100 |
| 1149. | AATAATTTAAGATCATATTTCTTT[G,A]TAAAATTTAATACATAAAATTACCA | 422,416 | 100 |
| 1150. | AACCACTCAAGTTGGGATAAGTGA[C,T]ATGTGATATATAACTTTATACAGAA | 422,467 | 100 |
| 1151. | TATACTTAAGAAATAAATGTATAG[C,A]ATATAACTATCAAAAACTATATAGA | 422,524 | 100 |
| 1152. | ATAGCATATAACTATCAAAAACTA[T,C]ATAGATCAAAATCATTAATTCACAA | 422,544 | 100 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 1153. | TCTTATCTCTACTAATGACAAACT[C,T]GGTTACAACTATTTTCTTGTCCATG | 422,634 | 100 |
| 1154. | AAACTCGGTTACAACTATTTTCTT[G,A]TCCATGCCTAATATATCCAACCAAT | 422,653 | 100 |
| 1155. | AACTATTTTCTTGTCCATGCCTAA[T,C]ATATCCAACCAATCAACATAATTCC | 422,665 | 100 |
| 1156. | ATTTAAAATTATATAATTAAATAA[G,A]AAATTAAGATTTTATCTTGACTTGT | 422,829 | 100 |
| 1157. | ACTAAAGCATAACATTTCTTGCTT[T,C]GCATTTTCTTATTGGGATGATTGCT | 422,881 | 100 |
| 1158. | CATTTCTTGTTTTGCATTTTCTTA[T,C]TGGGATGATTGCTCTCATCCAAAAT | 422,893 | 100 |
| 1159. | ATGGTGGAAAACTTAGAAGAAGAA[C,T]AGTTGGTCGAATAATAACATCCGAT | 422,985 | 100 |
| 1160. | AACATCCGATGGCCCAAGTGGGTT[T,C]GATCTAGATGCCTTAGCTAGTGATT | 423,025 | 100 |
| 1161. | TCGTCTATGATGGGTTTCGTGGTT[A,G]CTTGATCAAGATCAAGGTGAAGAAG | 423,092 | 100 |
| 1162. | CCAGTGTCAGCCCATCTAGGTGAT[C,T]CAAATGATTAATCTATAATTAAGAG | 423,166 | 100 |
| 1163. | TGATCCAAATGATTAATCTATAAT[T,C]AAGAGCCAAATTATAGCTCAATAGA | 423,186 | 100 |
| 1164. | TAAAATCCAACAATGCCCGGCAAG[A,G]GTCGGGTTAGGAGTGAACAATTATA | 423,249 | 100 |
| 1165. | AATCCAACAATGCCCGGCAAGAGT[C,T]GGGTTAGGAGTGAACAATTATAGAG | 423,252 | 100 |
| 1166. | CCATCAAGTCTTCTAAATCTATCT[T,A]TCTTtCTTTTTTTTtATGCCTAAA | 423,341 | 100 |
| 1167. | AATCCAAGAAGAGAGATAACAATA[A,G]AGGGAGAATGTAGAGAGAGATGTGA | 423,389 | 100 |
| 1168. | CTTCTTTCTTCAAATAGAAGATTT[T,C]CCTTTCTCCCTCTCGTCCTCCAAAC | 423,480 | 100 |
| 1169. | ATGGCAGTGGATGGCTGAGGCCAA[T,C]AGCCTGCGATGGCATCCAACAGTGA | 423,530 | 100 |
| 1170. | CAACCCCAGTAGCAACAATGATGG[C,T]AGCTGGTGGCAGCAGTGGGCAATCG | 423,588 | 100 |
| 1171. | CAATCGGATATAAAGAAGAAGAAA[A,G]TCAAAGCAAAATAAGGCAAGAGGCC | 423,632 | 100 |
| 1172. | GAAGAAGAAAATCAAAGCAAAATA[A,G]GGCAAGAGGCCTTGCTTTGATCCAA | 423,646 | 100 |
| 1173. | ATGGCAATAATGGCCATGGTGGCC[A,G]ATGGTGGATGAATCAAAGAAAATAG | 423,768 | 100 |
| 1174. | ATGGTGGCCAATGGTGGATGAATC[A,G]AAGAAAATAGGGGATCCTTGGTGCG | 423,783 | 100 |
| 1175. | GGTGGATGAATCAAAGAAAATAGG[G,A]GATCCTTGGTGCGGCAAGATCTAAT | 423,795 | 100 |
| 1176. | TCAAAGAAAATAGGGGATCCTTGG[T,C]GCGGCAAGATCTAATGGTCTTTCAA | 423,805 | 100 |
| 1177. | TTCAAGAAGATCTTAGCCAACAAT[G,A]GCTACACGAGGATAGGAAGGAAGGA | 423,850 | 100 |
| 1178. | TAGGAAGGAAGGAGAGAAAGTGCC[C,A]ATGAGATGGGAGGCGATGCCTCATC | 423,887 | 100 |
| 1179. | TCATCTCCTATGATGGTTCAACCA[C,T]GATTGGGCTAAAACTTTTtTCTCCT | 423,932 | 100 |
| 1180. | ACTTTTtTCTCCTCCTTTTTtGAC[A,G]ATGCAATCAATTGATTTCTACCTAG | 423,969 | 100 |
| 1181. | GACAATGGAGGCTAAGGTTTCCAT[G,A]CATCCAATGAGTTTGAGAAGAAGCA | 424,039 | 100 |
| 1182. | ACTCCTTCGACTCAAACAAGGAA[A,G]GGAAGGTCTTTCCTTCCTTCCTATT | 424,097 | 100 |
| 1183. | TGGGTAGGGTATCACAACAGTTTT[G,A]TTTCTAAATTGTCATTATCAGGAAG | 424,187 | 100 |
| 1184. | TACACCACATTCGATGTAGAAAAA[C,T]TGCACCACTCCGCCTAATTGAGCCA | 424,249 | 100 |
| 1185. | ACCACATTCGATGTAGAAAAACTG[C,T]ACCACTCCGCCTAATTGAGCCACAT | 424,252 | 100 |
| 1186. | TATCTTATGGCCATATTATAATAT[C,T]CTGCAATCAAATTATGATTTCTTAT | 424,403 | 100 |
| 1187. | TTATGGCCATATTATAATATCCTG[C,T]AATCAAATTATGATTTCTTATATAC | 424,407 | 100 |
| 1188. | CATTGGAAAACGGTGCATTACATG[A,G]CTCAATCAGATGGCGCGGTGCATTT | 424,705 | 100 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 1189. | GCGGTGTACAAAGAATTTCTCTTA[C,T]TAGGAAATATCTTGAGTCTAGACCG | 424,769 | 100 |
| 1190. | CTAGGAAATATCTTGAGTCTAGAC[C,A,T]GGCCCATTTGTCATTTAGACCAATC | 424,793 | 100 |
| 1191. | TCAAGGACTATGAATTTTGGTCCA[T,C]AATAAGTATGAGATCGTCATGGGAT | 424,841 | 100 |
| 1192. | CATAATAAGTATGAGATCGTCATG[G,A]GATTGAAAAAGATGGGAAATAACTC | 424,863 | 100 |
| 1193. | GATCGTCATGGGATTGAAAAAGAT[G,A]GGAAATAACTCCTCAGTTTGCCCCT | 424,877 | 100 |
| 1194. | AAAGATGGGAAATAACTCCTCAGT[T,G]TGCCCCTTGACAGCTCACAATTCTT | 424,895 | 100 |
| 1195. | CCAATGCTATCCATATAAAGGTA[T,C]TTGTTTTCTATTAATGTCATTGCAC | 425,010 | 100 |
| 1196. | ACTAATGAAGACAGCTTCAGCAAA[G,T]ATAGAGCAGAAATCCTTTAAATTTT | 425,058 | 100 |
| 1197. | AAGGGAAATCATTGTGGTTCACAG[G,A]TGGGGGTAGAGCATGTAAGATACGA | 425,549 | 100 |
| 1198. | ATTTGTATTCTGTTCTGCCCCCAG[A,C]AATCAGCATAGGCACCATGATGCAT | 425,635 | 100 |
| 1199. | AACTTCAGAATTTTTTGGCCCATC[C,T]AGCTCTTTAATTTGATTTTTGATGC | 425,707 | 100 |
| 1200. | GAGAACAAAACTCTCTTCCTTGTC[C,T]TTGTCTGCTATTTCTTTCTGATATA | 425,969 | 100 |
| 1201. | ACATCTCAACAACCATAACTGAAG[C,G]CCCTTCAAAGCTAAATGCCTGTTA | 426,632 | 100 |
| 1202. | CCATAACTGAAGCCCCTTCAAAGC[T,C]AAAATGCCTGTTAATTTGTTCTTCA | 426,644 | 100 |
| 1203. | AATGGCATTTTTTCCTAGATGTCC[A,C]TACCGATACTAACGGTATTTTGGAG | 426,701 | 100 |
| 1204. | AGTCTCTAAAATTTTCACTTGTTG[T,A]TTCCATTGATTCTATTTCTTTATAT | 426,820 | 100 |
| 1205. | ACAACACTATTCACACCATCAAGA[C,T]CAGACAACCCTTCATCTTGGATATG | 427,075 | 100 |
| 1206. | CAAATGAAAAACCTAAAATGCTGA[A,G]AGGAATCTCCACAATTATGGAGGAA | 427,448 | 100 |
| 1207. | GAGGAATTAGTACTTCTTAGACCA[C,T]GAAGCTAAAACTAGATCTGCAATCC | 427,492 | 100 |
| 1208. | GCCGAGTGTCACCAAAACATTATT[G,C]AAGTTGCTAAGCCAAGCCCTCAAAG | 427,567 | 100 |
| 1209. | TTTTTGCGTGATGCATATAGGCCT[G,T]GTAGATCACCAAAACCAGACTCGCC | 427,721 | 100 |
| 1210. | GTAAGTCCAGGTTTTCCAGTAGTC[C,T]TGTGATTCTTGCCTCCAGCTAATGC | 427,777 | 100 |
| 1211. | CCAGCTAATGCTTTAGCAGACCAT[T,A]GCAAGCAAATCTCTGTCAGCAACTA | 427,816 | 100 |
| 1212. | GCAGACCATTGCAAGCAAATCTCT[G,A]TCAGCAACTATATGGTCACTTGGAG | 427,831 | 100 |
| 1213. | TGCTTGTCTTTTTGCTTATAGCCT[T,C]CAATTTATTTGATATTATAGTATTA | 427,898 | 100 |
| 1214. | GCCTTCAATTTATTTGATATTATA[G,A]TATTAACCCAAGCTCAAGCTCGACT | 427,918 | 100 |
| 1215. | TTATTTGATATTATAGTATTAACC[C,T]AAGCTCAAGCTCGACTCGATGAAAA | 427,927 | 100 |
| 1216. | AAGCTCGACTCGATGAAAAATAGA[C,T]AAAACTCGAGTTGAGCTTGAATATC | 427,958 | 100 |
| 1217. | TCGAGTTCGAGATCAAGTCTTAGC[T,G]TACTAATAAGATATATATATATATA | 428,021 | 100 |
| 1218. | AACTTTGACTCATTTGTATACATC[G,A]TAAGCTTCTAAAGATAGCCATAAGA | 428,943 | 100 |
| 1219. | AAGGAGGGTGGTACCAACCTATCG[G,A]CTGAAGTTTCGTTGGTGAATGTTAA | 429,038 | 100 |
| 1220. | TACCAACCTATCGGCTGAAGTTTC[G,A]TTGGTGAATGTTAATTTTTGCAAAT | 429,049 | 100 |
| 1221. | ATACAAGCCAATGATCTGTATTTA[A,C]TTAGCTCCCAGTTGCTAGATGGAAT | 429,250 | 100 |
| 1222. | tGGATTGAAGGTACTAAAGCATTT[A,G]AAAaTAAAAaTTTCTCACAATCCG | 429,322 | 100 |
| 1223. | ATTAATCAGCAATCACTAGGTCGC[A,T]GGTTTGAATTCGGCAAGTTAGATTT | 429,411 | 100 |
| 1224. | TTATCCTTTAAAATTTTTACATCA[T,C]AAACTTTAAATTATAATTTACAAAT | 429,561 | 100 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 1225. | TTTACAAATATTTATTTCATTTAT[A,T]ACAACAGAACATATAGCATGAGAAG | 429,602 | 100 |
| 1226. | TTATTTCTCAAAAATGTTTTTGTG[T,G]CAACACATCTAACAATATCATTGTC | 430,072 | 100 |
| 1227. | CTCAAAAATGTTTTTGTGTCAACA[C,T]ATCTAACAATATCATTGTGAAACTT | 430,078 | 100 |
| 1228. | TTTGTGTCAACACATCTAACAATA[T,G]CATTGTCAAACTTTTATATAAAGCA | 430,090 | 100 |
| 1229. | ATTATTCAATACTTTTAATCTTGC[C,A]TTTGCTATGCCGCTTTTAGTTTCTT | 430,550 | 100 |
| 1230. | CTTAACCCCTTTTTATAGATGCTT[T,C]TGATGTAACCGTCGAGCACATATGC | 431,574 | 100 |
| 1231. | TGTAACCGTCCAGCACATAGTCCC[A,G]CTTTTTATGACGCTAAATTATCGGG | 431,602 | 100 |
| 1232. | CGGGCCATAAATATAAAATTAATG[A,G]GGCGTTAATTCTCCTTAATAGCCGT | 431,648 | 100 |
| 1233. | GCTCAGTCGGTCGATGAAGAGTCA[G,A]AACTGCATGTTCAACCGATATGCAG | 431,905 | 100 |
| 1234. | TACCCCAACAGTTACCCCCACTCT[C,T]AAAGTCCAAGGTGAACCGACGTGTA | 431,993 | 100 |
| 1235. | CAGTGTCAGACATCATTTTGGAAA[A,G]TCAATTCGACGTCGGATGATATGAT | 432,212 | 100 |
| 1236. | GACAAATAGATTTGTGCCATATGT[C,T]TGAATGTTATTGGGTCGGATCTGTT | 432,265 | 100 |
| 1237. | AGATGTTGCCACATGTCACATCTG[A,G]TAAATTTTCGATTCAATCACCTTCA | 432,384 | 100 |
| 1238. | CCAACGTCTGAGGTTGTTATTTTC[G,A]TCTTTTTCAGATCAAGTTTCTGTCT | 432,536 | 100 |
| 1239. | TCTCTTATGGCTAGGACTTCTTCT[T,C]TTTACGGTCGGTTGGAGAATCCGAC | 432,635 | 100 |
| 1240. | TTTGCCCCTAGGGCTGATGGTCGG[A,G]TGAATATCCCTTTTTTGGGCCAGGT | 432,788 | 100 |
| 1241. | CCTGGCACAGAAGGAGCTTGTGAA[C,T]GAACAGACCCTTTATGATGCCGACC | 433,272 | 100 |
| 1242. | GACTTTACTTTTCTTTTACTTGTT[T,G]AGTTGTACTGACTTCTATTGTAATT | 433,370 | 100 |
| 1243. | CTCCATCTGCATCGGTTCCTGAGC[C,T]GATCCCGATACTATCAGCCCCGACA | 433,598 | 100 |
| 1244. | TCTGAACAATCTGTGGCTGCGCCA[G,A]TTGCTCCTTCAGCTGGGGCGCAGTC | 433,750 | 100 |
| 1245. | GGGACTGCCGGCAAGGGATCGGGG[G,A]AAAGCTCTGGTGACTTCGACGGAAG | 433,830 | 100 |
| 1246. | TTCACTTCGACCTTCAAGTACCTG[A,G]TGATAAATTGACCCTGGCCAATCCG | 433,904 | 100 |
| 1247. | AATAAGGTGGCAGCCGTCGATGCT[G,A]AGAAAGCGGCCGCACTCGAACAACT | 434,192 | 100 |
| 1248. | GACGGATGCATCGAAGAACTTAAA[A,G]TCGAACGTGGATGTCATTGGGCCAG | 434,411 | 100 |
| 1249. | TTGAGTCAGACAATCAAGGATTTT[T,C]GGAGTTCGAAAGAATTCAAGGAAGA | 434,555 | 100 |
| 1250. | TACCCGAAGCTCGACTTGAGCAGT[A,G]TCGTCCCTCCAAGATCGGAAGATGG | 434,675 | 100 |
| 1251. | AGCAGTATCGTCCCTCCAAGATCG[G,A]AAGATGGGGTTGTTGAAAAAGAAGC | 434,695 | 100 |
| 1252. | TTGGGTAATCAAATACCTATAATC[G,A]GACTTCAGTCCAATTTTGTAACTTT | 434,862 | 100 |
| 1253. | AGTCAGTTTTTATAGTGGAAAGCC[A,G]ACATTAAAAATCAAAATATAATCGC | 435,288 | 100 |
| 1254. | AGTGAAAGCTGAAATAAACTCTAT[G,A]TCGAAGTACAGTCGATAGTTTGGCT | 435,464 | 100 |
| 1255. | ATTGATAGAACTTGACCAAGGTTT[C,T]TGATTATAATACTGAAGATTCTGTA | 435,544 | 100 |
| 1256. | AGGTGATACATCTTCAGATTGTCG[G,A]CATTTCATGTTCAAAAAATTATCGA | 435,630 | 100 |
| 1257. | AGCTTGCTGTCGGAGTTCTGAAAG[G,A]AGATTTAAGTCGGCTCTTCGATATT | 435,893 | 100 |
| 1258. | TTGATGGCAATCCAATCTCGAGCG[G,A]GATCATTGCTTCTGTTCTATAAGCC | 435,979 | 100 |
| 1259. | AAGGATCAAATATGTCGATTCTCC[A,G]TTGTACGAAGGGCTATGGTGCTACA | 436,443 | 100 |
| 1260. | CAATCGATGTCAACTGACTAGCCG[G,A]TTGATGTTGTATATTTACATACCTT | 436,491 | 100 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 1261. | GATTTATCTCCCAAATAATTTTCA[C,T]AAATCTCTTCATGTACTTCTCTAAG | 436,631 | 100 |
| 1262. | GAATCTCATCAGTCAAGTATTGGA[C,T]GATCGGATCCATCCAGCTTGGTTCG | 436,818 | 100 |
| 1263. | ATCTTTCACTTTCTAAAGATACTT[T,C]ATCATAGTGGGGTCTCAGGCTTCAA | 437,044 | 100 |
| 1264. | CACCCTTGACTTGTCCAACAATCC[A,G]TTGTGAGTCGGTGAAGACCTTCAAA | 437,096 | 100 |
| 1265. | AGAAATGAATCGACTGAGTGCGAC[G,A]ATCCTTCCATTGAGTTACTGTATCT | 437,928 | 100 |
| 1266. | TCGGGTTTAACTTCATCTGATATC[G,A]TCGAAGTGTGCCAAAGGCTTTCTCC | 438,107 | 100 |
| 1267. | CAAAGGCTTTCTCCAGATCTCGAA[T,C]ATGATCTGAAGTTTGGAGACTCTTC | 438,140 | 100 |
| 1268. | CTTCATATTTCATCCAATCTGGGC[C,T]TTGAAGATCTTATTgACgAGCCGTT | 438,213 | 100 |
| 1269. | CTGGGCCTTGAAGATCTTATTgAC[G,A]AGCCGTTGATAAGTCGCTCCGATAT | 438,231 | 100 |
| 1270. | TgACgAGCCGTTGATAAGTAGCTC[C,T]GATATTTTTCAAACTGAAAGGCATT | 438,251 | 100 |
| 1271. | TGATAAGTAGCTCCGATATTTTTC[A,G]AACTGAAAGGCATTACTTTGTAACA | 438,262 | 100 |
| 1272. | GTCGGTTACAAAAGTCGTGTGCTC[C,T]TCATCTTTTAGTGCCATCCAGATTT | 438,324 | 100 |
| 1273. | GTGCCATCCAGATTTGATTATACC[C,T]GACGAAGGTATCCATGAAACTCAAA | 438,359 | 100 |
| 1274. | TATTTTtCATTGGCTTTTCTCACC[G,A]TTACCACATTGGCGAGTCAATCGAG | 438,514 | 100 |
| 1275. | TCATCCGAGTATGGCATTATGAGC[C,T]GAAGGTACTCGAACTATCGTGAACG | 439,078 | 100 |
| 1276. | ATGGCGTCAAGACTCTTCTGAGTC[A,G]TCAGTCGGTAGTCGCATTCGAGAGA | 439,224 | 100 |
| 1277. | AAACTTTTATTATCTACAATAATT[T,C]TTTTtACATCATAATTTGCTATTGT | 439,300 | 100 |
| 1278. | AGACAACAACAGCATCATCATGGG[G,A]AGTTTGAATTCTCCAAACATCCTCT | 439,355 | 100 |
| 1279. | TTGAATTCTCCAAACATCCTCTTC[T,C]GAAAAAATTATTACATTGTTGAGTC | 439,383 | 100 |
| 1280. | AAAAAATTATTACATTGTTGAGTC[G,A]TCGTCGTTTCACCGACTCTTCTTCA | 439,409 | 100 |
| 1281. | TTCACCGACTCTTCTTCAGTAGTT[G,T]CCCTCAAGTCCAGTCGTTCGGAGAT | 439,441 | 100 |
| 1282. | GATATTTTTGAAGTAGCCTCATT[A,G]AATCAGGGCTTCTATCTCATCCCTG | 439,586 | 100 |
| 1283. | TTAAATCAGGGCTTCTATCTCATC[C,T]CTGAGTTGAATGCATTATTCGGTAT | 439,608 | 100 |
| 1284. | TAAATCAGGGCTTCTATCTCATCC[C,A]TGAGTTGAATGCATTATTCGGTATC | 439,609 | 100 |
| 1285. | ATCACGATGGAACCGACAATACTT[C,T]CTTCGATTGCGATTCCTTAATGATG | 439,668 | 100 |
| 1286. | ACGGAGAGCAAAAGAGGAGTGTA[G,A]AAGTCATACCTGCTGTAATTCAGCC | 439,779 | 100 |
| 1287. | GGGCGAAGCTTGCTTATTGGATGG[C,G]GGCCGACTTGATTCAGCCAGAGCTT | 439,845 | 100 |
| 1288. | CTTTTGTTTCTTCTTCTTCTAACC[G,A]TTGCCTTTTGTCGGGCGTCGGCCAG | 439,902 | 100 |
| 1289. | ATTTGTGACGGCCTTCGACTGCTA[C,A]TGAAGTGAGCCACGAAAGAGTGTTC | 440,191 | 100 |
| 1290. | GAGCCACGAAAGAGTGTTCGAGCT[A,G]TCCAAAGGAGTATATACTTTTCGAT | 440,222 | 100 |
| 1291. | CTTTCTGAAGAGTCGCTGGAAAGT[C,T]GATGCACAAGAGGGCGTTGGTCACC | 440,299 | 100 |
| 1292. | TCGATGCACAAGAGGGCGTTGGTC[A,G]CCCCCTGAATCATCATGAGAGCCTT | 440,322 | 100 |
| 1293. | ATGGTCGATCGAATCAGTGGAGCC[G,A]TCATATGGCTCCACTTACAGTATTT | 440,384 | 100 |
| 1294. | AGCCGTCATATGGCTCCACTTACA[G,A]TATTTTGAACTGAGATGGGATCGGC | 440,404 | 100 |
| 1295. | GCTGGAAAACTCTGAGGGTAGAAC[T,C]CCCTGACGAGCTTGAGGGAGAAGCA | 440,593 | 100 |
| 1296. | CGATCATTTTtCCTTCCTAATACG[G,A]TCGAGATGGGAAGGAGAGGAATGTC | 440,654 | 100 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 1297. | GGGCTCTGGTCTTCGTCATGGTGT[G,A]TATGATCTTTACCCCTTCCTGACAT | 441,058 | 100 |
| 1298. | TCGTCATGGTGTGTATGATCTTTA[C,T]CCCTTCCTGACATACCAATCTGTTG | 441,070 | 100 |
| 1299. | GATGATTCTGGTGTAATCATCGAG[T,C]ACATGATCCTATTTTTTATGATGCT | 441,332 | 100 |
| 1300. | GGGTGTTTATTTTTCTTAATAGCC[A,G]TGACATGTAGTTGATAACCGTTTGT | 441,403 | 100 |
| 1301. | GTGACGGTTATGGTATTTTGAGCA[G,A]ATTAGCCGATCATATATCGGTAGAA | 441,451 | 100 |
| 1302. | CGGTCAGCCGACAGTAAGTCGGTG[C,T]AGTTCGCTTAGTCAGTCGATAAAGA | 441,624 | 100 |
| 1303. | GAATGATTATTATCGTGTAAAAAG[A,T]TTTTCTCTCTCTCTCATTCTCTC | 441,753 | 100 |
| 1304. | TGTAAAAGATTTTCTCTCTCTCT[C,T]CATTCTCTCATTGTGTCTCTCTCC | 441,768 | 100 |
| 1305. | CACAGGTTATTCGGTTGTAGATTA[G,T]ATCTATAAAGGACATAAGTTATGGA | 442,064 | 100 |
| 1306. | TGTTTATTTACTTTATAATTTTCA[A,T]TTTAAATATGATGAATCTGGTAAAT | 442,114 | 100 |
| 1307. | TCTGGTAAATTGGCAATTCACTGC[C,A]CTTGATATTACGGGCAAGAATTACC | 442,154 | 100 |
| 1308. | GGTACGGCATGATTGGATGCACTT[G,A]AGGTTGCAAGATTTTAAAACTATGT | 442,433 | 100 |
| 1309. | TGGATGAGGTCGTGGGCATGGCCA[T,C]GGTGGTTTCAAAAATATTGGGACAA | 442,778 | 100 |
| 1310. | ATGATGGCAATCCAAATGTGCCTC[C,A]TTTTGATGTCTTCGATTTTTtGCC | 443,040 | 100 |
| 1311. | AAAATTGACTACATGATCATTGAT[G,A]GAGAAATAGTTAAAGAATAATTTTT | 443,102 | 100 |
| 1312. | GAAGAGCAACTATAATACTGTCAG[G,A]TGGTACAAAGTTAGAAATCAACGAA | 443,407 | 100 |
| 1313. | GTGCATCATTTTTTATGATTCAAA[C,T]AGAAAACTTGAGTTAAAAAATTTTT | 443,561 | 100 |
| 1314. | CAAACAGAAAACTTGAGTTAAAAA[A,T]TTTTTTtGTTCTTTCGCCAGGATTG | 443,581 | 100 |
| 1315. | AATAAATATAATATTGAACCAGAA[T,G]TTCACTAAAAAaGAAATGTTTATTC | 443,657 | 100 |
| 1316. | GAAAGGATTCAACGAGACATATAT[G,A]GTCCAATTCATCTCCCTTGTGGACC | 443,898 | 100 |
| 1317. | TCTCATATTCTAGCTGAAATACTC[T,C]AGCTCGGATAAAAGTTTCAATAGGA | 444,768 | 100 |
| 1318. | TAAATTATAAATAAATAAAAGTTA[C,T]TTTGGTATTTTTTCATCATAAATGT | 444,058 | 100 |
| 1319. | AGTTACTTTGGTATTTTTTCATCA[T,C]AAATGTTTCATCTTCTAATGAACTC | 444,077 | 100 |
| 1320. | CTCCTGTGTTGTGGTGAAGTCCTT[G,A]GGACTATTTAGACTCGATAAAGGAA | 444,124 | 100 |
| 1321. | AGACTCGATAAAGGAAGATTTGTC[G,A]CTTAGTCCTTAAACCTGTTTGCGAC | 444,158 | 100 |
| 1322. | AGATTTGTCGCTTAGTCCTTAAAC[C,A]TGTTTGCGACCAAATGATACGTTGT | 444,173 | 100 |
| 1323. | TGTCGCTTAGTCCTTAAACCTGTT[T,C]GCGACCAAATGATACGTTGTTACCA | 444,178 | 100 |
| 1324. | CACTTACACCCTATGGGTTTCATT[A,C]CTTCGGGTGAGTCAACCAATGTCCA | 450,527 | 100 |
| 1325. | TCCACTTACACCCTATGGGTTTCA[T,C]TACTTCGGGTGAGTCAACCAATGTC | 450,529 | 100 |
| 1326. | CTGCGCCCCTCTTCCTCTTGAAGA[T,C]CCACTTACACCCTATGGGTTTCATT | 450,553 | 100 |
| 1327. | GATAATTTATTTAACCTGTTTAAC[T,C]TATTTAATCTATTTCTGATCTATTT | 455,693 | 100 |
| 1328. | ATCGAATTTGAATTTTAGATATCT[G,T]ATCCATTTAATCCGTTTAACCCATT | 455,776 | 100 |
| 1329. | ATTTGGGTCATAAATGGATCGATC[C,T]ATTTAATCTATTTAATAATTAGATC | 455,823 | 100 |
| 1330. | ACAGGTTAGGTTTAGGCTAAACA[G,A]ATTTGGGTCATAAATGGATCGATCC | 455,848 | 100 |
| 1331. | ATAAATTTACTGCAAAGGCAATAT[C,T]AGGTTGGATATAATTAGTAAGATAC | 456,464 | 100 |
| 1332. | AAGTTGCAACCATTGTCTGTTTTA[C,T]AAATTTTCATGAGATGGCACAGTCA | 456,713 | 100 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 1333. | GTAAAATATGTTTAGTTCAATCTC[C,T]TTTGATAAATCTTCTTTTAACTTGT | 456,917 | 100 |
| 1334. | TTACAAAGAAAAATAATATTTCTC[G,A]TTCATTTACAAAAGAAAaTAATATT | 457,512 | 100 |
| 1335. | AGAGAGAGGAAATCTTTTCATACG[G,A]TAATAATCCTTCTCATTTCATTCCA | 457,589 | 100 |
| 1336. | TGAACACACATTTAAATATTCAAA[T,C]ATATTGTAGAATAATAAAATATATA | 457,671 | 100 |
| 1337. | GAATATTTAAATTTATATATAATT[T,A]TATATAATTTTATATAGTATTTATT | 458,384 | 100 |
| 1338. | TGTAACAGGCAGAAGCAAAGGAAC[T,C]GCATACCTTGATCTAAAAGCCTGCT | 460,498 | 100 |
| 1339. | TTTATCTGACTGATGGGATAAGCA[A,T]GGCAGTAAAAACTCAAAGACTTTTA | 460,849 | 100 |
| 1340. | TCATAGAGCCTTGTCTCAGCTATC[T,A]GGAGTTTGCTTAATGGATCCTCATT | 462,136 | 100 |
| 1341. | CCCAGGTTGGTATCAAAATGTCAC[A,G]GGTTCAAATCCCCATTTAGACCATT | 522,806 | 100 |
| 1342. | CTTGAGTCATGCATGGTCCAGGCT[A,G]CATGTGGTTTTAGCAGCATAAGCAT | 522,924 | 100 |
| 1343. | GTATTATGAAGTAATACCAATTGA[G,T]AAAATATTATAAAGTAATAGTCAAA | 523,012 | 100 |
| 1344. | AAAGTACATGTCACAAACATGGTT[C,T]AATATGATTAAAGTAATAGGCAAGT | 523,059 | 100 |
| 1345. | AAGTACATGTCACAAACATGGTTC[A,G]ATATGATTAAAGTAATAGGCAAGTG | 523,060 | 100 |
| 1346. | AACATGACATTACTCTCACATGTA[T,C]GATAACTTTATTCAAAAAAaTAAAG | 523,305 | 100 |
| 1347. | TGTATTTCCATGTTAGATTCCTAT[C,T]ATAAGGAAGCTCGCAAAAAAaTAT | 523,859 | 100 |
| 1348. | ATCATAAGGAAGCTCGCAAAAAAA[A,T]TATGATTTGATGAATTTTTTtCTC | 523,881 | 100 |
| 1349. | GATGATCAGCAAAACGAAATAATA[T,C]GAGGTAAGGTTCAGCAAATTTAAAC | 524,120 | 100 |
| 1350. | GAGCACATTGCTTTTCTCTAGCTC[T,C]ACATGATCATCGATTTTAGCCTCAA | 524,514 | 100 |
| 1351. | AGTATTTCTTAAGAACAGGGGTGG[C,G]AATTTCTGACCCAGACCCCACAGAC | 524,692 | 100 |
| 1352. | TCACCTTAAATAAACAAGTTTCAA[T,G]GATGTGTTTTtATAATAAGGTTTTG | 524,752 | 100 |
| 1353. | AACAAGTTTCAATGATGTGTTTTt[A,T]TAATAAGGTTTTGTTTCAGGTTAAC | 524,764 | 100 |
| 1354. | TTTCAGGTTAACCAAGACCAATCT[G,A]ATTACAACTTGGTCAGGCTTGGTTT | 524,802 | 100 |
| 1355. | AGTACCGGTAATCTAGTTGAGGCT[T,C]AATTGCATGATTAGGGAGGCTATAT | 524,922 | 100 |
| 1356. | TTTCCACTTAATTTCCTCTCTCTC[T,C]GCATGTGTGTGCATTTGGATTCACA | 525,050 | 100 |
| 1357. | TTTGGCCCTATTTCAGTTTTGTTT[A,G]TAAAGGTATATAATTGAAAAGTGAA | 525,116 | 100 |
| 1358. | CAAAATGGGTTTTGACCCAACCTA[A,C]ATATAACCCACCCAATGCCACTGCT | 525,255 | 100 |
| 1359. | CCCAATGCCACTGCTACTCAAGAA[T,A]GAAAATAAGGATATAACAAACCCTT | 525,290 | 100 |
| 1360. | ATAAAAaGACAAAGGTTCATACA[C,A]CTAAAAaTTATCCATATAATCACT | 525,535 | 100 |
| 1361. | AATAATCCATTAGAGAAACAAAGA[C,T]GTAGATAATCACCTTCTTCATGCGA | 525,602 | 100 |
| 1362. | AGAAACAAAGACGTAGATAATCAC[C,A]TTCTTCATGCGAGAGCCAAGAAACA | 525,615 | 100 |
| 1363. | GATTAAGTTTTGTGACTTTTAGCA[T,A]CAGTAGTTCAAAGTAACTATATACT | 525,791 | 100 |
| 1364. | CCAAATTAAGCAAACTTCTGAAAA[T,A]GTGGACTCCATATTAAAGGTGAATG | 525,867 | 100 |
| 1365. | ATTAAGCAAACTTCTGAAAATGTG[G,C]ACTCCATATTAAAGGTGAATGAAAT | 525,871 | 100 |
| 1366. | CTCAAATTCTGGGCTCATAATATT[G,A]AGTTCTCAATCAGCTTGATAACATA | 525,955 | 100 |
| 1367. | GTACTAAGCACGACGCTTTGGTAT[T,G]GCACATGATGTGGCACCAGCTCAAG | 526,158 | 100 |
| 1368. | GCACGACGCTTTGGTATTGCACAT[G,T]ATGTGGCACCAGCTCAAGTAAAACC | 526,165 | 100 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 1369. | CTCTCATACGTACCTAGTGGTGTT[T,C]GGCCAACCATAAGGAGAGGGAAAGA | 526,454 | 100 |
| 1370. | GCACAAGTTGAGGGAAGCTAAACT[T,C]CTCTTTAATGTAGTTGTATAGATTT | 526,671 | 100 |
| 1371. | ACAAGTTGAGGGAAGCTAAACTTC[T,C]CTTTAATGTAGTTGTATAGATTTCC | 526,673 | 100 |
| 1372. | ACTTGAACTTGTGTTACCCTCTCT[C,A]TCTTTCCAGATGTGAATATGGGACA | 526,755 | 100 |
| 1373. | GGAGGGAAAAaGAAAGGATGGAGT[G,T]TGTGGGAGTGGGACTTGCAGTGTTT | 526,823 | 100 |
| 1374. | CAATGTATTTAGGCATCTATTATC[A,G]TCTAGTGAAACAAAGGAAATGGGAA | 527,090 | 100 |
| 1375. | TAGATGCCATCCCAATAGTAGTCC[T,C]ATGCATATTTAGTCAAGCCCTACGT | 527,150 | 100 |
| 1376. | CCACTAAATACCTAGGTTCCCGGT[G,A]TCTCACTCCTTGAATTAATTTATCA | 527,294 | 100 |
| 1377. | AAGGAAGCAAGAGATGCAGATTTG[C,T]GGGGGACTCAGATGTGCAGGACTGC | 527,384 | 100 |
| 1378. | ATACACAGAAAAAAAaTGGACCCT[T,C]AAACAACCACACCGAATGCTTATTG | 527,830 | 100 |
| 1379. | AGTCTTTCAAAAATGCAACAAAAA[G,A]AAAAaTGTAGATCGTTCAATTTGAA | 528,005 | 100 |
| 1380. | CCCCTTGCAGATCTCCTTCGGCGT[C,T]GGCAGATCCTTCCCTAAATTCGACC | 528,320 | 100 |
| 1381. | TTTGGGCAAGCTTGCCAATGAAAG[A,C]CTAGTTTTGTCTAGCTTCGTATATA | 529,465 | 100 |
| 1382. | CATGATACAAAATAACTATTAGAT[T,C]ACTCGAGAAGATAGGAAAGAATTGT | 530,032 | 100 |
| 1383. | TTTGTTAGGCATCTTTAGAAAAAT[A,G]ACTTTTGTAAGTTAATTTtGTTttA | 530,109 | 100 |
| 1384. | GTTAATTTtGTTttAGTATAAATT[T,A]TGAAACTACTGGCATATTACTCACA | 530,144 | 100 |
| 1385. | ATATAATTTTTtAGACATTAATAT[C,T]TATTCTATTATTATATAAAATTTTt | 530,256 | 100 |
| 1386. | ATATAAAATTTTtATTTtATTGAT[G,A]AATGTATTTATTGATTTTTaTTAAA | 530,293 | 100 |
| 1387. | AATATATTATTTTATCAATATAAA[A,T]TTTAATTTATTAATATATTATTAAT | 530,364 | 100 |
| 1388. | ATCATTAACCCTAACTTATGCATA[T,C]GTAGGATCCAAACCAGATCACCAAA | 530,949 | 100 |
| 1389. | AAACCAGATCACCAAAACCAACTT[T,C]CGGTGAGCTAGTTGGCATCCATTAT | 530,983 | 100 |
| 1390. | TTGATACGCTTtCTCTCTCTCTCT[C,A]TATATATATATATATATTGATCATT | 531,894 | 100 |
| 1391. | GAGTTGACTCATGATTCGATCCAG[T,C]CTGACCCGTTTAGATCCGATCCTAT | 531,982 | 100 |
| 1392. | TGGATCATTTGAATATTTGCATAT[C,A]TCATACTCTCCAAGCATCATCTTCT | 533,135 | 100 |
| 1393. | AAAGAGTCTGGATTGAATTTTATG[A,G]GATTGGACCATTTATATTCTACTCC | 533,781 | 100 |
| 1394. | AGAATGGGAGTAACCCATTCCATT[T,C]CTATTTTAGGCCCCAATTCTCTCCA | 533,871 | 100 |
| 1395. | AAATCGAAATATAATTTAAATAAT[C,T]GGGAAGAGTAGAGAATAGATTTTGA | 533,932 | 100 |
| 1396. | AATCGAAATATAATTTAAATAATC[G,A]GGAAGAGTAGAGAATAGATTTTGAG | 533,933 | 100 |
| 1397. | ATTGAAAATTTTCTCAAAAATTG[G,A]AATGGAAATAGAACTTTCTCTAACC | 533,985 | 100 |
| 1398. | TGCTCGTTCTCATTCCCATTTGAG[A,G]CTCCAACTCCCTTCAACTAGATGTC | 534,053 | 100 |
| 1399. | CTTTCGTTCAGAAAATTTTAACAT[G,A]TTCAACCTGAAAGGAGGTATCCCTG | 534,102 | 100 |
| 1400. | AAAGGCATTCAAGCTGCCATAGCT[A,T]TCTTGCAAGCTACCTCACTAGAGAT | 534,259 | 100 |
| 1401. | ATCACTTGCCTTTATTCTCCTGGG[G,A]CAATTGCTTCCTCTTTGAATCCTTT | 534,335 | 100 |
| 1402. | TCTCCTGGGGCAATTGCTTCCTCT[T,G]TGAATCCTTTGCTTCTGGATGCTTG | 534,350 | 100 |
| 1403. | TTCTTTGAGGAATCCAAAACTTGC[T,G]TTTTTTtCCCATCTATGAAGGAAAC | 534,405 | 100 |
| 1404. | TGGGCCAAAACAGGAGAGACAAGA[G,A]CTCACATTTTAGGTAAAACATACAA | 534,609 | 100 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 1405. | CCTGAGTTGAAATCAAAGCGGAGTG[C,T]GTATGGGAACCCAATCATGGACTAG | 534,683 | 100 |
| 1406. | CCCCTCTGTTAGATGACAAGAATT[C,A]CTCATTTCGAAGGTTGGATGATGCA | 534,754 | 100 |
| 1407. | TTCTCATTGTCTTTTATTTTTTTt[A,T]TTtAGTTTATTTAGTAGTATTGCTT | 535,138 | 100 |
| 1408. | AAATAAATAACTAAGTAAATGAAG[C,G]TTCGAGGGCCATTTTTTGTGAGAAA | 535,209 | 100 |
| 1409. | AAATAACTAAGTAAATGAAGCTTC[G,A]AGGGCCATTTTTTGTGAGAAAGTTG | 535,213 | 100 |
| 1410. | GTATTTCAAAAGGTATGAAGTTCA[C,G]GTCAGCCCTATACCTATTTCTAGTT | 535,471 | 100 |
| 1411. | CAAAAGGTATGAAGTTCACGTCAG[C,A]CCTATACCTATTTCTAGTTTGTTCT | 535,477 | 100 |
| 1412. | TCTCACCTAAATGGCCTAAAAATA[T,C]TACTCCACTTAACCCTCTTGAAAAC | 535,624 | 100 |
| 1413. | ACCTAAATGGCCTAAAAATATTAC[T,C]CCACTTAACCCTCTTGAAAACCAAC | 535,628 | 100 |
| 1414. | GCTTCCTCACTTATGAGTGCACAC[T,C]ATTGAGAAGGCCTGTTGTATCCTGA | 536,779 | 100 |
| 1415. | CTCACTTATGAGTGCACACTATTG[A,G]GAAGGCCTGTTGTATCCTGAGGGAT | 536,784 | 100 |
| 1416. | TAAAGGATAGAAATGGATCCCACT[A,G]CTACTAGTACCATTGCCGCTAGTTC | 536,950 | 100 |
| 1417. | CCCACTACTACTAGTACCATTGCC[G,A]CTAGTTCCTCCAATGCTACATCCAC | 536,698 | 100 |
| 1418. | GCCATACCGTTGCTTCCTACCATA[C,T]CTCTCACTGCACATGAGGGGTTTCC | 537,034 | 100 |
| 1419. | ATACCAGCAATATAGAGAACTGGA[G,A]GCATGCAAATAAGACGTTGGCCAAC | 537,218 | 100 |
| 1420. | TGAAGATAAGGATATCAAGATGCA[G,A]ATCAACGAGTACCACAAGCTGATAG | 537,308 | 100 |
| 1421. | TATAGCTGGCATGCTGATCGAAAA[G,A]CTGCCCAACTCGTGGAGCGACTACA | 537,398 | 100 |
| 1422. | ACAAGCAACAACTCAAGCACAAGT[A,G]CAAGGAGATGTCGTTGGAAGATTTG | 537,445 | 100 |
| 1423. | GGAGAAGAAACTATTTACTTAGGT[A,G]ACTCAAAATCTACACAAGTTCTTGG | 537,915 | 100 |
| 1424. | TTCTCAAGCTCACCTCAGGCAAGA[T,C]ATTGGCATTGAATGAAGTGCTCCAT | 537,979 | 100 |
| 1425. | CAGAGACTCTTTGTACTTTATATT[G,A]TTGAAGTAATTAATGAAAATGCATG | 538,157 | 100 |
| 1426. | ATAATGCTTGCATGAACAAGTGTG[G,A]AATTTATGCTGAAACCAAAACAACT | 538,320 | 100 |
| 1427. | TTTATGCTGAAACCAAAACAACTA[G,A]AAAAACTTATGCATTTGTGGAAAGA | 538,347 | 100 |
| 1428. | TATGCATTTGTGGAAAGAGAATCT[A,G]AACTTTTAGGATTAATTCATACTGA | 538,379 | 100 |
| 1429. | ATTGATGATTATTCTAGGTATACT[G,A]AGATTATTTATTGAGGAATAAAGA | 538,487 | 100 |
| 1430. | GATTCCATATAAAAACACCGATAA[G,C]ATACCTTTTGAATTGTGGAAGGGTT | 538,831 | 100 |
| 1431. | ATACTGATCATAGTGCAGCATATA[A,G]GTTTCTTGTTTTGAAAAATGGCATG | 538,995 | 100 |
| 1432. | CATAGTGCAGCATATAAGTTTCTT[G,A]TTTTGAAAAATGGCATGCTTGAGTG | 539,003 | 100 |
| 1433. | TTTAGAAATGATTtTtGTATCTAT[T,C]TTATTGATAAAGATCCTGTGTCTTT | 539,204 | 100 |
| 1434. | AGAAATGATTtTtGTATCTATTTT[A,G]TTGATAAAGATCCTGTGTCTTTTTC | 539,207 | 100 |
| 1435. | TCAAAAATGAACTTGATCAATTT[C,T]ACATAATCAAACTTAAGAACTAGTT | 539,301 | 100 |
| 1436. | AACAAAATGTGCAAATTGAGAAAA[T,G]CTTTATATAGTTTAAAACAAGCTCC | 539,659 | 100 |
| 1437. | TTTAAAACAAGCTCCAAAACAAATG[A,G]CATAAGAAATTTGATAGAGTTTTAA | 539,694 | 100 |
| 1438. | GAGTTTTAATGGATATCAGATTTT[C,T]TTCTATTGGAGTAGATAAATGTGTG | 539,735 | 100 |
| 1439. | TACACCAAGACTATTGATAATGAC[T,C]GTGTGATTATCAATTTGTATGTGGA | 539,785 | 100 |
| 1440. | AATTGTGAAAGAAACAAAAGGTTT[T,C]TTAGCCTCCCAATTTGACATGAAAG | 539,865 | 100 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 1441. | ATGAAAGATATGGGAGAAGCCAAT[A,G]TGATTTTAGGTGTTAAAATCATAAG | 539,908 | 100 |
| 1442. | TATGGGAGAAGCCAATATGATTTT[A,G]GGTGTTAAAATCATAAGAGATATGA | 539,916 | 100 |
| 1443. | CTGTTTGTACTCCTTATGATGCTA[A,G]TACTCAATTAAAAAaGAAGAGAGGT | 540,038 | 100 |
| 1444. | ACATGACCTGATATAGCTTATGCA[G,A]TGTGTAGATTGAGCAGATATACTCA | 540,151 | 100 |
| 1445. | AGATATACTCAAAATCCCAATCGT[A,G]ATCATTGGACTACTTTAGTCAGACT | 540,190 | 100 |
| 1446. | GAGATGAATTTAGCCGATCCTCTG[C,A]CTAAACCTTTGGGCAGAAAATTCAT | 540,685 | 100 |
| 1447. | CCCTTATGAGTGGTGTATTGAATT[A,G]CAGTGTACACTTGATGGAATCACTT | 640,962 | 100 |
| 1448. | TATATATGAGTGCGAAGTGGGGTC[G,A]CTTCTGTAAGATTCTTTGACAAGAT | 541,013 | 100 |
| 1449. | TGATTCATAGCTCAAAAGGCACCA[A,G]TTTCGATGCATTACACTCAGTTGAG | 541,252 | 100 |
| 1450. | CATAGCTCAAAAGGCACCAATTTC[G,A]ATGCATTACACTCAGTTGAGTTAAC | 541,257 | 100 |
| 1451. | TTTTACCAACATCCTCTCACCTAA[A,G]TGGCCTAAAAATACTATCCCACTTA | 541,509 | 100 |
| 1452. | TTATATTATGGCAACAATACTTCG[T,C]CATATTTCAAAAACaGGTAAAAGCT | 542,089 | 100 |
| 1453. | CAATACTTCGTCATATTTCAAAAA[C,T]aGGTAAAAGCTATCCATCTTTGAAA | 542,103 | 100 |
| 1454. | CAGCTTTCTCTGATTGGTCCCCAT[A,G]TGCCAATCGGATGAACTCATCATCC | 542,257 | 100 |
| 1455. | TTCACCTACGTTGCCTCCTTTTAA[G,A]TGGTCGGCATTCGTTTTAAACGGTC | 542,417 | 100 |
| 1456. | CCCCAAAAATAGCTGTTTGTTGTT[G,A]TAGGTTTTCTTGTTCCCATGTACAA | 542,499 | 100 |
| 1457. | CCGGAAGCGACTTAGCTTAGCTAC[A,T]TAAAGATTTTGACCAATGGTGCGTA | 542,761 | 100 |
| 1458. | CCAATGGTGCGTACATCGAAAGCT[T,G]CTGTACCTATAAAGTACAGCTGACC | 542,798 | 100 |
| 1459. | GTTGATTATTGCTTAAAATTGCGG[C,T]TGTGTTGTCATCATCTTCATTATGG | 542,966 | 100 |
| 1460. | TTATGGAATTCATGAGAATGTTAT[G,A]GGAATGCATAATTATATTCATAATA | 543,010 | 100 |
| 1461. | TAACTGATTTTCACATGCAAATAT[C,A]ATGAATTATATATAGATAGCTGGGG | 543,080 | 100 |
| 1462. | CATGCAAATATCATGAATTATATA[T,C]AGATAGCTGGGGAAGAAATGAAAGA | 543,093 | 100 |
| 1463. | GGTTCTGCTAGGTATCGGGAAAAA[G,A]GGGTTCTCGGAATACACCCAAATTG | 543,264 | 100 |
| 1464. | GGTATCGGGAAAAGGGGTTCTCG[G,A]AATACACCCAAATTGTAGAACATGT | 543,274 | 100 |
| 1465. | ATGTATTGGTTGCAAAATGAAATT[A,G]TGACATAGTCATATGTAAATAAGCT | 543,320 | 100 |
| 1466. | TAAGTCATAATTTATGCACCAATG[A,G]CAAAAAATTAGGGTTGAAAATTGTG | 543,418 | 100 |
| 1467. | TGCATAAGCTAGAATATGTATACA[G,A]GCATTTTATGTGTAACTTCAACATT | 543,482 | 100 |
| 1468. | GAATATGTATACAGGCATTTTATG[T,A]GTAACTTCAACATTAAAATTATTTC | 543,493 | 100 |
| 1469. | CGGCAATTTTCTTAGATGGTTATC[A,T]ATAATTAGAACCTCATTTTTGCAAT | 543,544 | 100 |
| 1470. | AAGTATAAAAATAAAATTGATAAC[G,A]TATCAATAACCTGAGTTTATCTATA | 543,633 | 100 |
| 1471. | ATTGATAACGTATCAATAACCTGA[G,A]TTTATCTATACCAAATGCTAAGAAT | 543,648 | 100 |
| 1472. | ATAGCTCGCAACCTTTGCTAAATC[A,G]TTCATTACTCGTAAAAATCTAGCCT | 543,696 | 100 |
| 1473. | TTtCTTGAATATTAGATTTTTTC[A,G]CATTCACATGTTCCACATCAAGAAG | 543,754 | 100 |
| 1474. | CACATCACATGTTCCACATCAAG[A,G]AGGGGATTGTGGATTCTCTACATTC | 543,777 | 100 |
| 1475. | AGGGGATTGTGGATTCTCTACATT[C,G]TTGTCTAAACCGGTTCCTATTAACA | 543,802 | 100 |
| 1476. | AACCGGTTCCTATTAACATCATAT[A,G]CCTTTTTCAATTTACTAGCATAAAT | 543,834 | 100 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 1477. | TTAAGCTTGCACTGTGGTCATTAG[G,T]TGGTTGGACTGCCCCACTCACACGG | 544,022 | 100 |
| 1478. | TTAGATGCTAACGTGCACCAAGCC[A,C]GCAGCGGCACCACCTCCACAAATGG | 544,075 | 100 |
| 1479. | GGCGATGCGAACCACCGCCGCTGC[A,G]ACGTCGCTGCGCCGCCTGTCGTGC | 544,349 | 100 |
| 1480. | ATGCGAACCACCGCCGCTGCAACG[G,C]TCGCTGCGCCGCCTGTCGTGCCTTC | 544,353 | 100 |
| 1481. | AGCGTCCGGAGGTGTTCGTCGGCC[G,A]TGAAGGCGGTTTCGTTGCAGACACC | 544,566 | 100 |
| 1482. | TTCGTTGCAGACACCGGTGGCGCC[T,C]GTGGAGGTGAGTTGGTTTTtATTAG | 544,601 | 100 |
| 1483. | AATTAATATTTTTGCTGCTTACT[A,T]GGTAATCCTGGCTCTTCCTTCTCGA | 544,878 | 100 |
| 1484. | TTTTTTGCTGCTTACTAGGTAATC[C,T]TGGCTCTTCCTTCTCGAAATTtATT | 544,886 | 100 |
| 1485. | TTTCTGTTGGAAAATTAGAAAGAA[A,C]GAAAAAGTTCCTGTTTCATTCTTTT | 544,952 | 100 |
| 1486. | AAAATTAGAAAGAAAGAAAAAGTT[C,T]CTGTTTCATTCTTTTTTtACGAGCAA | 544,962 | 100 |
| 1487. | AAAAAaTAAGTGAAGTGTCAACA[G,A]ATTTTGGATGATATTTGTCAAAGA | 545,326 | 100 |
| 1488. | AGAACTTTACACCTTTCATTTCTC[T,C]ACTCTGCATTTTCATGTAGTACGCT | 545,698 | 100 |
| 1489. | CATTTCTCTACTCTGCATTTTCAT[G,A]TAGTACGCTTGTAACTGCATCTAGC | 545,714 | 100 |
| 1490. | CTACTCTGCATTTTCATGTAGTAC[G,T]CTTGTAACTGCATCTAGCAAAAGTA | 545,721 | 100 |
| 1491. | AAGTTCATCTTTTACTTGCTCTAT[T,G]TTTCTAGTAGAATCACTACTATTGT | 546,331 | 100 |
| 1492. | TCATCTTTTACTTGCTCTATTTTT[C,G]TAGTAGAATCACTACTATTGTCTAT | 546,335 | 100 |
| 1493. | AAAaaTAATCTAGTGTACATGCAA[C,T]GACAGAAAGACAAGGATCTTGTATT | 546,439 | 100 |
| 1494. | TATTGGACATTTTATCTGTTATTGA[C,A]TGAGACTGACCAATTCTTTAGATGTT | 546,781 | 100 |
| 1495. | CTTAGGACTTCTGACAAGCTGTAT[C,T]CCTGAATTAGATTGATAAATATTCC | 546,912 | 100 |
| 1496. | TCCAAGTAAGTTTGGTTTAGATGT[A,G]AGGTCCAAGATACCCTTGGATCAAG | 547,243 | 100 |
| 1497. | TTTAGATGTAAGGTCCAAGATACC[C,A]TTGGATCAAGGCTGGGTAGGTCTCA | 547,258 | 100 |
| 1498. | ATTGTAAGTTGTTCATGGTGACCG[A,G]CTTAAAAAACAAGATTCATTGATTTG | 547,442 | 100 |
| 1499. | TGTAAGTTGTTCATGGTGACCGAC[T,A]TAAAAACAAGATTCATTGATTTGTG | 547,444 | 100 |
| 1500. | TGAATAAAGTAGTATTCTTCACCT[T,A]TAAAAACAAGATTCATTGATTTGTG | 547,461 | 100 |
| 1501. | GTGATCTGGCTGGATTTTGCTCA[G,A]CTCAACTGACTTGATTGAGTTATAA | 547,868 | 100 |
| 1502. | TGACATATAATGATGATAATATAT[G,A]ATACATATATTATAAAATAGTAAAT | 548,042 | 100 |
| 1503. | GGGTTACGTTTATGAACATTTTT[C,T]TTTGAAAGCTTCCTGAGCATTATTT | 548,210 | 100 |
| 1504. | AACATTTTTCTTTGAAAGCTTCCT[G,T]AGCATTATTTTTACTAAATTTTAGC | 548,225 | 100 |
| 1505. | TGCACATGCATGCATGTAGATGAC[T,C]CTGATTTTTAAGAAAAAaTAAATTT | 548,282 | 100 |
| 1506. | GAAAGGTAGAGAGCACTTTATTTC[A,G]GGGCACAAGGGAAAGAAAAGAGATC | 548,549 | 100 |
| 1507. | TTTTATTATACTTTTtGAGAAGTG[T,C]AATGTATGGCTGCAGGCTTTGCGGC | 548,610 | 100 |
| 1508. | CCCATTGGTTATGTTCTCATTCTT[T,C]TGAGAGTGTTAAGACTCACTCCTAC | 548,885 | 100 |
| 1509. | TTACTGGGATACTGGTTGATAAT[G,A]ATGTTTGCATGTGTGTCTTGATTAT | 548,952 | 100 |
| 1510. | TGCTTGCAGTTATGTTTGCTTGCT[C,T]CCCCTGCTACTTGCTCCTGCACTGC | 549,042 | 100 |
| 1511. | TGCATGTGTTGGTGTGCTTGGAGC[A,G]CTTTTTAAAGTTCATTCTGACTCTG | 549,119 | 100 |
| 1512. | TTAAAGTTCATTCTGACTCTGAGT[G,T]TCAAATTTACTCCTGCAACTAAGAA | 549,148 | 100 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 1513. | GAAGAAATATTTTACTAGAAACTA[T,G]AATTCACAATGTGTAACACATCCGT | 549,222 | 100 |
| 1514. | AAGTAGATGAATCCTTCTAGTAGT[T,G]GTCACCTTGAAGTTACAAAGTATTG | 549,433 | 100 |
| 1515. | GTCACCTTGAAGTTACAAAGTATT[G,T]CAAGCCATCAATGATAAAAAaTTA | 549,458 | 100 |
| 1516. | TTGGCTCTAAAATGCCACATCAGG[A,G]CACATTCTGGTTGCTTAACTTATTA | 549,662 | 100 |
| 1517. | TTAATCTTTTATTGTTGCCATTAT[A,C]TTTTTTtGTTTtGTTTTAAGTTGT | 549,717 | 100 |
| 1518. | GAAGAACGTTATTCTTAAATCTTG[T,C]TGTTGATTGGCCCAGCTTCGCTTTG | 549,959 | 100 |
| 1519. | ATATCTCTTGACAATCTCCCCATG[C,T]AGAACGTTGCTGCTGTGACTTCGAC | 550,179 | 100 |
| 1520. | TCTTGACAATCTCCCCATGCAGAA[C,T]GTTGCTGCTGTGACTTCGACATCAA | 550,184 | 100 |
| 1521. | GAACGTTGCTGCTGTGACTTCGAC[A,G]TCAACACGCACTCCAATCTACAAGG | 550,205 | 100 |
| 1522. | TTCGACATCAACACGCACTCCAAT[C,A]TACAAGGCCTATGCAAAAGGAGAAA | 550,223 | 100 |
| 1523. | TAGTATATTAAATGTCTAGGAGTA[T,G]GAAAGGGTTTACAAGACCTGATCCG | 550,378 | 100 |
| 1524. | ATATTAAATGTCTAGGAGTATGAA[A,G]GGGTTTACAAGACCTGATCCGAGTA | 550,382 | 100 |
| 1525. | ATGACCCTAGAGTCATAAAAGGAT[A,G]TTATAAGATTTCTATGGTATTTTTT | 550,517 | 100 |
| 1526. | GGCCTCTTTGGCTACAACTGCAGG[C,G]ATAGGTTGGGATTGGACAGCTGGAA | 550,648 | 100 |
| 1527. | TCCTATATATTGGACTTCTAGGAA[A,G]CACATAATCACATTGCTGTCTTTCA | 550,890 | 100 |
| 1528. | GCACAAAGTCCTTCCAGCTTTGAT[A,G]TGCCATAACAACTCCATTTCAAAAG | 551,019 | 100 |
| 1529. | TCCAGATTCATAAGGAGGTCTCAT[A,T]GGTGAAGCCCCATAATGCCAGTCAT | 551,144 | 100 |
| 1530. | AAGCCCTTTAGCATCCACGATAGA[G,A]TGTGAGAGGTCCCTGACAGAGATTC | 551,199 | 100 |
| 1531. | TTGATGAATTCATCCCACATTTCC[A,C]GATATTGTTGACCATTTTTTCTTCC | 551,279 | 100 |
| 1532. | AAAGAATTGGCCATTGACCAAAAA[C,A]ATAGAGATCTGATTTGGTTTCTTTG | 551,960 | 100 |
| 1533. | TTAAACCGATTTCCACAATATTGT[T,G]CATAAACTTTAGATAACTTCTAAAA | 552,053 | 100 |
| 1534. | AGCTGGTGGGATGCTAATTGGTAT[A,G]GTCCCACATTGTGAGCCTCAAGATA | 552,543 | 100 |
| 1535. | TTGATATGGCATGGTACAACACAA[T,C]ACTTAATATTCTGCTCTAGCAATGG | 552,632 | 100 |
| 1536. | GGTGGCTGTACGAGCAATGATAGA[T,C]ATGTTTTGGATGGACCCAGAAGAGC | 552,694 | 100 |
| 1537. | GATATGTTTTGGATGGACCCAGAA[G,T]AGCTATTTTTGATGGTTTAATTATG | 552,716 | 100 |
| 1538. | TAAAGACATGTATTAAGACACAGT[T,A]TCATAGCATGATTATCCTAAAAAAT | 552,964 | 100 |
| 1539. | TGAAATGTACACAATACAATGAAA[G,A]GATAAGAAGTTATTATGTAACATAG | 553,022 | 100 |
| 1540. | AATGTACACAATACAATGAAAGGA[T,C]AAGAAGTTATTATGTAACATAGTGC | 553,025 | 100 |
| 1541. | ATATATGACTAGTAAATCAGGTTT[T,G]AGTGGCTTGTTTCTTTCTTGGTTGT | 553,134 | 100 |
| 1542. | AGAAAAAGAGCAGTTTTGAAGGCT[G,C]ACAAACAAATTTAGTTTCAGGTATC | 553,249 | 100 |
| 1543. | CTTGATACTAGGATTGTCAAATCA[C,T]GATTTATTTACACATCATGGCATGC | 553,298 | 100 |
| 1544. | TCCTTGTGCATGCCTTCAGGAAGG[G,T]GTGCCAACCAGCTTCTCTATGTGAT | 553,717 | 100 |
| 1545. | AGTAATTTTGCACAGCTGCAGAAG[G,T]CTAAACTTATAGGTCTGTTTGAGT | 553,999 | 100 |
| 1546. | GCTTACTTCTATTATTCTGTATAT[T,C]GTGCAACTTACATTACTGAACATTG | 554,174 | 100 |
| 1547. | TATTCTGTATATTGTGCAACTTAC[A,G]TTACTGAACATTGTCATCCTTGAAA | 554,186 | 100 |
| 1548. | CCCTTCAAAGGATAAAATTTATGC[A,G]TTGCTTAAGGATCAAGCAAAGTCTG | 554,352 | 100 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 1549. | ACACATACATATATATGCAAGTAC[G,A]TAGTAAAAAATAGATCACAATTAGA | 554,808 | 100 |
| 1550. | GTAAGTTTTAACATTCATGTCAGT[T,G]AAAATCAAATGAAGTAAACTTAGAA | 554,956 | 100 |
| 1551. | AGAAGTCCGGAAGAGGAAATTAAA[T,A]CCATTATCCAAACAGAAAAAAGGAT | 555,002 | 100 |
| 1552. | TATTTCCAGTATTTTATTGGAAAA[G,A]ACTGCCATGGTTTTATAAATTTTGA | 555,076 | 100 |
| 1553. | TTTTATAAATTTTGACCTTTGGCT[G,A]GGCAAGTGCCTTTCATCTTATAGAT | 555,111 | 100 |
| 1554. | AAGAGAACTGGCTTTTATTATTAT[G,T]CTCACAACCGGCTCCTTTCTTGCAG | 555,544 | 100 |
| 1555. | TGGATAATGTCAGACTCATTGCTT[A,T]ACCCTGGACGAGCTCGGCTTTGTGA | 555,597 | 100 |
| 1556. | TTACTCAGACAGCAGATATGGCTT[C,T]TCCAAAATTATTCCTAAAGTTCACA | 555,794 | 100 |
| 1557. | TATGGCTTCTCCAAAATTATTCCT[A,T]AAGTTCACACCATACTGCAACACTC | 555,810 | 100 |
| 1558. | TGGCTTCTCCAAAATTATTCCTAA[A,T]GTTCACACCATACTGCAACACTCTA | 555,812 | 100 |
| 1559. | ACTTTTCTCTTCGTTTtCTTTTTt[C,A]CTTTtCCTTTTTTtCATTCAATCTG | 556,254 | 100 |
| 1560. | tCTTTTTtCCTTTtCCTTTTTTtC[A,G]TTCAATCTGTATCATACTTCAACTT | 556,270 | 100 |
| 1561. | CATTGAGATTCATGTTGAAATGTT[C,T]ATATCCTTCATACCCATCAAATGAC | 556,678 | 100 |
| 1562. | ATATCCTTCATACCCCATCAAATGA[C,T]AGCACATTGTTATCCCTCTTGACAT | 556,703 | 100 |
| 1563. | TCAGAAATGCAGCAACCTAGGACT[T,C]ATCTTCTGGCATGTGGAACCTAGGG | 556,752 | 100 |
| 1564. | ATGTGGAGATGGGACTCTTCAGGT[C,A]ATCTTCTTTGGGAGTCTCTTAGGCC | 556,901 | 100 |
| 1565. | AAATCTTGGCAAGGAAAGGCTGAA[G,A]CCTGCCTAGGGGTCATATTTTCTAC | 557,019 | 100 |
| 1566. | CTAGCTATTTGAAGAGAAGATAAA[G,A]CATATGCTCTCCTGCAAAGTTGCCC | 557,069 | 100 |
| 1567. | CCAATTAGAGATGCCTACAATGCG[C,T]GAAGGAACCTAAGGATGCGAAAGGT | 557,215 | 100 |
| 1568. | ATGCCTACAATGCGCGAAGGAACC[T,C]AAGGATGCGAAAGGTTGAGGGCTAT | 557,225 | 100 |
| 1569. | ACTTGCTTTTCTCTTACACATGCG[A,G]CTTCCCTCCCCTATCTCAAAAAATA | 557,485 | 100 |
| 1570. | GACTTCCCTCCCCTATCTCAAAAA[A,T]TAAAAaTAAAAaTAAAAaTTATCCG | 557,508 | 100 |
| 1571. | TATCCGATTTCCTTACCATGTTAT[G,T]GAGTCTTGAAAATTGATTGGTCTTT | 557,552 | 100 |
| 1572. | TGGTCTTTCAATAATCGAACAATT[T,G]CTTTACTTTAATTATGGTTTGATAG | 557,594 | 100 |
| 1573. | TTTCAATAATCGAACAATTTCTTT[A,G]CTTTAATTATGGTTTGATAGAATGG | 557,599 | 100 |
| 1574. | TAAACCATCACACTTTGGATATAG[C,T]TGATAAAACAAGAAGATATGCAGAT | 557,653 | 100 |
| 1575. | ATTCAATTGGTTATGTTATCACCG[G,A]AAGATCCCTGCGGTCGACACTTTAG | 558,021 | 100 |
| 1576. | GGATATCATTATATCAATCACTCT[A,G]TAGTTCCTATGATCAGAGAGAAACTA | 558,280 | 100 |
| 1577. | CGGTCTTCCATTGGCAATGGCTGG[A,G]AAATATTACTAGCTATGATGAACTA | 559,158 | 100 |
| 1578. | AATGTGGACAATTAATTTATGAGA[G,A]AGAAAATTCCCAATTATTCTTGAGA | 559,590 | 100 |
| 1579. | GACGGCACCAAAGTTATGGTTTGC[G,A]ACCCCCCcTCCCGTCAAGGGGGAGT | 560,280 | 100 |
| 1580. | TCAGGGGAGTATGTGTGCATAG[G,A]TAGAAGGCAATCCCATGGACGGCAC | 560,318 | 100 |
| 1581. | ATAAATTATAAAATGTGATGCAA[T,C]TCCAAAACTGGGCAAACACCTCTCA | 560,630 | 100 |
| 1582. | AACACCTCTCATGTGCAGAAAGCC[T,A]TCAACTTAGCTTGCTCTCCACATAA | 560,669 | 100 |
| 1583. | TAAAATTCATATTTCTCTGTTAAT[G,T]GTTAGTTTCAATTAACTTGATTCCA | 561,423 | 100 |
| 1584. | CCATTCTTTTCAGATTCCAACATT[T,G]TGTTAATTCATCCACTTCTGATTTT | 561,470 | 100 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 1585. | ATCCATGGTGACCCACAGGTTCCG[A,T]TATGCCGTGCTGGCGAAATGCATGC | 562,172 | 100 |
| 1586. | CTTCCCGTTAATTACTTCATCTTC[G,C]TCACACCATAATGAAGAAAATAAAA | 562,390 | 100 |
| 1587. | ATAATTGCTAAAGAAAAAGATGGCG[G,A]TCTTCGTCGCTAGCAATGACATGGT | 562,474 | 100 |
| 1588. | TGCTAAAGAAAAGATGGCGGTCTT[C,T]GTCGCTAGCAATGACATGGTGGTAA | 562,479 | 100 |
| 1589. | TATTGAGTATTATTTTTtCCCAT[T,A]ATCAAAAGAAAAAaCAAGCAGTTCTG | 562,850 | 100 |
| 1590. | AAAGAAAAAGCTTCATAATTTCTC[A,G]GCATTTGATCATTTAGGAAGAGTCT | 563,346 | 100 |
| 1591. | TTGATCATTTAGGAAGAGTCTTGG[A,T]GAACCTAGGAAATTTTGGAGAGATT | 563,375 | 100 |
| 1592. | TTTCTAAGAACTAAAAAAAaaCTA[G,A]TGCCTCCATTCATGGAATATATGAA | 563,436 | 100 |
| 1593. | TGAAATGAAACTGAAGCCTAACCT[T,C]CAGTAGAATTTGAAAGAGCATCACC | 563,638 | 100 |
| 1594. | ACAGAGTCCATGGAAAAGAAAAaC[G,C]CATTGCCTAAACCACTTATGAAAGT | 563,750 | 100 |
| 1595. | CAGAACTGCTCCACCACACTCTCC[T,C]CCTGCCTCTGGAGCCTCCACCCAAT | 564,118 | 100 |
| 1596. | TCTACAAACACACACACACACACA[C,G]AGAGAGAGAGAGAGAGAACACTGCA | 565,190 | 100 |
| 1597. | ATATTAGATTAAGAAGCATGAAGG[T,C]TCCCATGGACTTTTTTATTCATATT | 565,388 | 100 |
| 1598. | GAGTAACTGAGAGAGAAGACTAGA[A,G]GAGATTTATGAGAAAAACTGCATGG | 565,692 | 100 |
| 1599. | ATTTATGAGAAAAACTGCATGGTA[A,G]GCCTGAAGTAAGAGCTCTTCTTTCT | 565,720 | 100 |
| 1600. | ATCTTCCAACTTTGGATTCCATGA[A,C]AAGAAGACTTTAGAAGAGTTGACAG | 565,882 | 100 |
| 1601. | AAGACTTTAGAAGAGTTGACAGGG[A,T]AAGAGGGGAATAAACAAAGAATATA | 565,910 | 100 |
| 1602. | GAATAAACAAAGAATATATTAAGA[G,A]GTGGAATGAAATTAGGATACATATA | 565,942 | 100 |
| 1603. | ATACAGAGAAGATTTTCTTTCTTA[A,G]AAGAGTGGATGTTTGCTTTGCTTGC | 566,073 | 100 |
| 1604. | TCAGTTACATAGATACTCAAAACTT[G,T]TTAAATTTATAACTTGAAAAaGAAA | 566,449 | 100 |
| 1605. | ATGGTAGAAGTTGTTATGGATCAT[C,T]GTAATGCTTATAATTTTATGAATAA | 566,566 | 100 |
| 1606. | ATAACAAATAACATAATTGAGTTA[A,G]AGATATAGATGCTGCAATAACAATA | 566,716 | 100 |
| 1607. | ATAATAACATACTGTTGAAAATGC[T,C]CGTGTCTTTTAAACCCCAATAAGA | 566,775 | 100 |
| 1608. | TTTTAAACCCCAATAAGAATTCT[A,G]CAAACTTCTATTTTGGGGTTAATTG | 566,806 | 100 |
| 1609. | AAAAAAAaTTTAAATAAAAGGATG[T,G]GTATGCCAATTAAATTTGAAATAAG | 566,930 | 100 |
| 1610. | GGTTAATTTCAAGATTCAAAGATA[T,C]GTGGGTCGCAACCTTAAATCATCAT | 566,982 | 100 |
| 1611. | AATCATCATATTCTCTTTTTTtA[A,C]TCACTAATAATTAGGGTTTGGATTA | 567,023 | 100 |
| 1612. | TCATATTCTCTTTTTTtAATCAC[T,C]AATAATTAGGGTTTGGATTATTCAT | 567,028 | 100 |
| 1613. | TTTTTTtAATCACTAATAATTAGG[G,T]TTTGGATTATTCATTGATCTAACTA | 567,039 | 100 |
| 1614. | GAATAAGGTTAATTATTATGATAT[G,A]AAAAGAATCATTTACTATTAAGGTT | 567,119 | 100 |
| 1615. | ATACTACGACGATTCCTATGCCAA[T,G]CTACAAATATTTTTTCTAAGCTTTT | 567,246 | 100 |
| 1616. | TTCTCTCAGAATCTGCATGACAAG[G,A]ATACTACCAATGTGCAGACATGGAA | 567,435 | 100 |
| 1617. | GAATGTTAGGAAAGAAGCTTGGAG[A,G]CAAGGTCTGAAAATGGAGGAAGAGT | 567,482 | 100 |
| 1618. | AAAATGGAGGAAGAGTCTGTATCA[C,T]GGTACTGTGAAGAAATTATTAAACA | 567,516 | 100 |
| 1619. | GAATGGAAGTCATCCATTCCGATT[T,C]TGATTCCAGACTTCCACTCCACCCA | 567,823 | 100 |
| 1620. | TAACTTCAATTTCCTATAATTTTT[G,A]AAGTTTCCCTGACTGTGTCGAGAAA | 567,977 | 100 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 1621. | CCTATAATTACTTTCTTTTAATAA[A,G]TCTGGGTGGCAATCCTTGCTTCCCT | 568,053 | 100 |
| 1622. | TCCATTAATTTGAAGTAAAGAATC[G,A]GTAGACGAGGGCAACCAACAAAAGT | 568,195 | 100 |
| 1623. | AGCATGCCATGCAAGCTGGTTCAa[G,A]ACTTGCAAAAGGCCTTGTCATGCTA | 568,268 | 100 |
| 1624. | TATCGCCATGTCTCCTCATTATGC[C,T]CATTAGACCATGAGCTGCCATGATA | 568,448 | 100 |
| 1625. | CTATGGCATGCAATGAGTGTGATG[G,A]CCAAGGATCTTTCAACATAGTAAAA | 568,559 | 100 |
| 1626. | GAAAGATTTTGTGTACTCAAAACA[C,G]AGGCTAGAACTCCGAACCAAGCAAT | 568,628 | 100 |
| 1627. | CCTTTCAAGGAATAATTTGCTCAT[A,G]GTTTGGAATATAGATGGCTGTAATG | 568,684 | 100 |
| 1628. | AAAATGCCCATCATGTTGCCATTG[G,T]CACAACAGCCAATATTTATACCATC | 569,071 | 100 |
| 1629. | AACTCTTGAGATTTAGATACATCT[C,G]CTTGTATGTTATTAGTGTTGATTAG | 571,753 | 100 |
| 1630. | ATCGGACGTAGTGGACGGAGAATT[C,A]CGCCTAGCCAAAGACATCACTTTAC | 572,655 | 100 |
| 1631. | ATATGCAAATAAAGATTTTCGAGA[T,C]CAATATAGAAAAATCTAAAAATTAG | 573,296 | 100 |
| 1632. | GAAGACCGGGACAACGGTTTTTCT[G,T]GGTGAGCATCGAGTGCCTTGTGGTT | 573,368 | 100 |
| 1633. | GGCACTGCAGTGATGGCCAGTAGC[A,G]ACTCAAAGGGTGATGCTTTGGAGAT | 575,751 | 100 |
| 1634. | TGATGGCCAGTAGCAACTCAAAGG[G,A]TGATGCTTTGGAGATATCTGGTGAG | 575,761 | 100 |
| 1635. | TTTGGAGATATCTGGTGAGGTATC[A,C]ACTTCTTTCTAGCAGTGGATTTTAG | 575,792 | 100 |
| 1636. | CATGATGGTGCAGTGAGAAACTTG[G,A]GGGAGGTCCGATACATATCCGATTT | 575,976 | 100 |
| 1637. | GGTGCAGTGAGAAACTTGGGGGAG[G,A]TCCGATACATATCCGATTTTAGATG | 575,982 | 100 |
| 1638. | TTCGAGAGGCTACAGGACGGTAGC[C,T]GGTGGAGGAATCTTGAAGGTGCTAT | 576,059 | 100 |
| 1639. | TGAGCCCACAGCGAGATCCAGGAT[A,G]ACGAACGAAGTCTAAGGAGCCTAAG | 576,535 | 100 |
| 1640. | CAGCGAGATCCAGGATAACGAACG[A,G]AGTCTAAGGAGCCTAAGAACAGCCC | 576,543 | 100 |
| 1641. | TATGCATGAAAGAAGGATGGCACG[G,A]TGCATTAGGCGGAGGCCGGTGGTGG | 576,616 | 100 |
| 1642. | AAGGATGGCACGGTGCATTAGGCG[G,A]AGGCCGGTGGTGGCATCGCGAGGCC | 576,628 | 100 |
| 1643. | GCGCACGCAGGTGCGCGCGGCCCA[G,A]TGCGTGaGCGGGCCCAGTGCAGGCG | 576,690 | 100 |
| 1644. | TGCACGATCGGACAGCTCTGGTGC[G,A]AGCCGATCACGATTGAACGGCCATG | 576,965 | 100 |
| 1645. | GCTCTGGTGCGAGCCGATCACGAT[T,C]GAACGGCCATGAATGATTCTAGGCT | 576,979 | 100 |
| 1646. | ACGGCCATGAATGATTCTAGGCTT[G,C]ATTGGGATTTtGTTTTTtAGTGTAA | 577,006 | 100 |
| 1647. | CTAGGCTTGATTGGGATTTtGTTT[T,C]TtAGTGTAACAGTGTTTTAGAGTTT | 577,022 | 100 |
| 1648. | TTTTATTCTCTCATAGTAAAGCTT[A,G]CACGTTCCATGAAGATAGGCTCGAG | 577,252 | 100 |
| 1649. | ATAGTAAAGCTTACACGTTCCATG[A,G]AGATAGGCTCGAGGACAATCCACGT | 577,264 | 100 |
| 1650. | AGATAATAATTATTATAATATTTT[G,T]TTTAGTATTATAATGATCTGTTATG | 577,496 | 100 |
| 1651. | TTTTGTTTAGTATTATAATGATCT[G,A]TTATGACATAAATAACAATTTTTAT | 577,516 | 100 |
| 1652. | ATATAATTTTTATCCAATGAAAAG[T,C]ATATGGAAGATTTCCTTAAATGGTG | 577,654 | 100 |
| 1653. | TACGTCCGGAATGCGATCATGAAT[C,T]TCTATGCCCAACATGGTCCTATTGA | 582,410 | 100 |
| 1654. | ACAGTGGATTCTGGCGATCGAGCT[C,T]TTTTAAAGAGATGGCGATTGCGAAGG | 583,126 | 100 |
| 1655. | AGCAGTCGGTGGAGAATCGCCGCC[G,A]ACAAAGTCTGAGCGGCCCTCCGACA | 584,325 | 100 |
| 1656. | CAAGCAGCTCATAAGGCTCTCATC[G,A]ACAAAGTCTGAGCGGCCCTCCGACA | 584,365 | 100 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 1657. | CATAAGGCTCTCATCGACAAAGTC[T,C]GAGCGGCCCTCCGACAATCCTTGGT | 584,374 | 100 |
| 1658. | TGGTGATGGGCGGAGGTGGGGTTC[G,A]TGCCAGCCCCACGGACGCTCGCCAT | 584,420 | 100 |
| 1659. | CCATGTCCAATTTTTGCTTTGTAT[T,G]GAGTCTACAAAAATCTTAAAGTAGA | 584,748 | 100 |
| 1660. | TTTCTGCAGTGCATGGACAACACC[G,A]CTGGGAATCCTCTTTGAAGTATGCG | 584,985 | 100 |
| 1661. | TAACAGTTGTCAATACGTGTTGAT[T,C]AGGCAATCCCATCCATCCAAGGTTT | 585,115 | 100 |
| 1662. | CATCCATCCAAGGTTTCACGAAGC[T,G]CCTGAAAATGAATATCGCGTATTAC | 585,149 | 100 |
| 1663. | TGCCTGCCGTGACTGCTGGGAAGC[G,A]AAGATGAGGCGGTAGGGGCAGCAAA | 586,375 | 100 |
| 1664. | GTCAGACGAGAAAGAAGAAAaCAA[G,C]ACATTCAATATAAGGAACTCATATA | 586,440 | 100 |
| 1665. | AAGGAAAAaCAGAAAGCAGCAAAA[A,G]AAaGAAATGGGGAAAAGGCTATGCA | 587,052 | 100 |
| 1666. | ATATGATTATTTAAGACAAGAAAG[G,A]AATAATCCTGGGAAATCATTGAGCA | 587,718 | 100 |
| 1667. | TTCATTAACCTGTATAAGATTGTC[A,G]ATCGAATAAATCCACATCCTCAGAT | 589,369 | 100 |
| 1668. | TGCATCTCATCACTAGTAGCATCA[G,A]GGGAAGAGGGTTGATGACTGTGCGG | 589,803 | 100 |
| 1669. | AGTGGGGGCGTTGGGGTGTCGTAC[C,A]GCCCAAGAAAAAaGAAATCTAAACA | 589,905 | 100 |
| 1670. | AATGACTCTACTGTTAGATGTATG[T,C]CCTAAAAGCCAGATTGGTTGAAACA | 590,055 | 100 |
| 1671. | TTAGTGGTTAATTTCTAAATGCTC[T,C]CGTTCGATAGAACGTCATGGGGACG | 590,270 | 100 |
| 1672. | AAAGTCCAGGTGCTTAATAGAGAT[T,C]AAGAGTACTGAGCGTGACCAACACG | 590,405 | 100 |
| 1673. | GTCGGTGACTTGCTCAAAGTTGCA[G,A]TGGTGTAGATAGTTCTTTAACCTGC | 590,482 | 100 |
| 1674. | AGTTCTTTAACCTGCGATGCCTCA[G,A]CTGCTTACAGCAAGGTTGCTATAGT | 590,517 | 100 |
| 1675. | CTGCGATGCCTCAGCTGCTTACAG[C,T]AAGGTTGCTATAGTTTGACTGCATA | 590,528 | 100 |
| 1676. | CTTCTAGCCATTTGGAGCCTTGAG[A,G]TGTATGTTGGCTACAGTAGATCCAT | 590,588 | 100 |
| 1677. | AGGAATAGGATGAGCATCAAAATG[A,G]AATTTGTCGACCCCGATAGATAGAG | 590,641 | 100 |
| 1678. | TAAAACTGAGTCCTAAAATCCATG[G,A]TCATGGTAGATGAATGATGAAAAAA | 590,710 | 100 |
| 1679. | CAATCCTTCGAAAAGAGTTTCCAT[G,A]ATATTGTTGATAGAGATCACAATAT | 591,014 | 100 |
| 1680. | TTCCATGATATTGTTGATAGAGAT[C,T]ACAATATATCTTACTATCGGATGGA | 591,032 | 100 |
| 1681. | GGGTTTAAGAAAACCCTGCTAGCA[T,C]ATGGTTAAACCCATTTTTtCCTACT | 591,184 | 100 |
| 1682. | CCAAATTGAAGCAAGCTCATTTAG[A,G]ACACCAAGAGTTGGAGTCCTTAAAG | 591,265 | 100 |
| 1683. | TTCTTCGACTAGATAAGAGGCACA[C,T]GCCGGCATGGATAAGATCCATGTGT | 591,366 | 100 |
| 1684. | ATCGAAAACGGAGAGAGTATCCTA[A,G]TCCGAATCCAAACGGATACCTGTAG | 591,997 | 100 |
| 1685. | CTCATTTAAAATTGTTTTAAATTT[C,T]TGATTTTCTTAATCTAGATGCATGA | 592,149 | 100 |
| 1686. | CTGATCTTGATCGGATCGCATGTC[G,A]GATCGAAAAATTTTTGAATTCCACT | 592,221 | 100 |
| 1687. | CTGATATCAGAGCCAGGTTGTACA[G,A]ATCATGCATCTTAAATTAAGATCAG | 592,313 | 100 |
| 1688. | CTTATTAGGACTGATTTTtATGCT[G,T]AATCTAAAGGTTATGATTAAATCTG | 592,512 | 100 |
| 1689. | TCTTAACATAAGTGTTATGTTGCA[T,C]GAGGTGTATTTTGCAAAGGATCATG | 592,612 | 100 |
| 1690. | TGTATTTTGCAAAGGATCATGTCT[A,G]GATCTATTTTGCATGAGATGTAATT | 592,641 | 100 |
| 1691. | CCCTAGATCCAAAAACCCTAGGAT[C,T]TGTTTGTATATGTTGCATTTAAGTT | 593,035 | 100 |
| 1692. | ATGAGTCGACTCAGTTGTGCAGAC[T,A]GAGGCTTACAGGATTTCTGTTCGTC | 593,241 | 100 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 1693. | AGTCTCGATTGTGATTTTTAATTG[A,G]GATCATGCTTACCTGGCCATGCATA | 593,779 | 100 |
| 1694. | CTCTTCCATGTTGACTGTTCTGGA[C,T]TGGATACAGTGATTCAGTTGCATCA | 594,048 | 100 |
| 1695. | AAGATAGGGTTGGACCTAAGATCT[G,A]TCAGATGAAGATCCAATGACGGTTT | 594,132 | 100 |
| 1696. | GTTGGACCTAAGATCTGTCAGATG[A,T]AGATCCAATGACGGTTTCACTCGCG | 594,140 | 100 |
| 1697. | TGCAATTTACTTGAGAAGCATTGG[G,A]CAAGAGTTGACCACCCATTGGTTGA | 594,274 | 100 |
| 1698. | CATTGGTTGACATATTCACCAAGA[C,T]CTGTCAGGTGAGGTGGTGTGCCAAT | 594,314 | 100 |
| 1699. | GGGAGCTCCGCAGAAATAATGAGA[A,G]CTAAGTTTGTTTCTAAAATAAATTC | 594,454 | 100 |
| 1700. | GCAGAAATAATGAGAACTAAGTTT[G,A]TTTCTAAAATAAATTCTCTAGAATA | 594,463 | 100 |
| 1701. | AAAaTTTCCTCTCTGTAGAATTTT[G,T]TCTCCTTCTAATAGTCTAGCCTGCA | 594,542 | 100 |
| 1702. | TTGTCTCCTTCTAATAGTCTAGCC[T,C]GCATCTTAAAAaTCAACCAATTGTC | 594,564 | 100 |
| 1703. | GATTGGCTAAGGGACTTGAAAaGC[A,G]TTTTGAGTTCCAAGAAGCTAGATTA | 594,630 | 100 |
| 1704. | TCCAAGAAGCTAGATTATGTCTTA[A,G]ACCAAAAaTGTTTATTGGGACCATG | 594,663 | 100 |
| 1705. | ATTGGGACCATGAAGTGTTCAAAA[G,A]ACACCTTTAGAAGGTATGTCGGACT | 594,701 | 100 |
| 1706. | TAAGCAACAGAGCAAAGATTACTG[T,C]TGTTGTCGTAGGGACCTATCTTCTT | 594,868 | 100 |
| 1707. | GTTACTGTGTACCTAATACAAGCA[A,G]AAaTTTGATTTTTATTTCATACTTA | 594,955 | 100 |
| 1708. | TGGTCACTTAATCAACAGTTTCTA[T,C]CATTTGCATGTTGCTGCAGATGAAT | 595,079 | 100 |
| 1709. | TACTAGGTCTGGTACATAGTGATA[C,T]ATGCGGCCTATTTGATGTGCCGGCC | 595,370 | 100 |
| 1710. | AAATTCAGATTTAAGGTAGAGAAG[C,T]AAACTGAGAAATCACTTAAGGTACT | 595,517 | 100 |
| 1711. | TTAAGGTACTTCGATCAGATCGAG[G,A]GAAATACCTAAGTGAAAAATtTCTC | 595,557 | 100 |
| 1712. | ACGCCTCAGCTCAACGGGATTTCA[A,G]AACAGAGAAATCAGACCCTATTAAA | 595,653 | 100 |
| 1713. | ATCCATTCCTACCACACCATATGA[G,A]ATGTCGCATGGTAAGAAGCCGAATT | 595,802 | 100 |
| 1714. | TTCCTACCACACCATATGAGATGT[C,T]GCATGGTAAGAAGCCGAATTTTGGT | 595,807 | 100 |
| 1715. | AATTAGAGACTAGGTCTATGAGAG[C,A]TCGTTTTGTAGGATACCTGAAAAAA | 595,908 | 100 |
| 1716. | AGAAAATGTTCCTCATAGGTGATA[T,C]GATGATCCTAAATCTATGACGAGAC | 596,195 | 100 |
| 1717. | CCTCATAGGTGATATGAACCATGC[T,C]GATGATCCTAAATCTATGACGAGAC | 596,205 | 100 |
| 1718. | TCTTTCACAGCAACTGTACATAGA[G,A]AAAGTGCTGAAGCGGTTCAGCATGG | 596,976 | 100 |
| 1719. | CTGTACATAGAGAAAGTGCTGAAG[C,T]GGTTCAGCATGGAGAATTTCAAGAG | 596,989 | 100 |
| 1720. | AGTCGAATCCAGATGAGGAGCATT[G,A]GATTGCTGTGAAGAATATCCTTAAA | 597,218 | 100 |
| 1721. | AAAGTCTACATCATGTTTTGTATT[T,C]CTGTGTAACGATGGTGCAGTTAGCT | 597,363 | 100 |
| 1722. | ATCGCCGCGTTGGAGGCTGCTAAG[A,G]AAAAATTCTGGTTCAAAAAATTTAT | 597,466 | 100 |
| 1723. | AAAAAATTCTGGTTCAAAAAATTT[A,G]TTGCAGAGCTGGATGTGATGCCACC | 597,490 | 100 |
| 1724. | GTTCAAAAAATTTATTGCAGAGCT[G,T]GATGTGATGCCACCAGATGCCATTC | 597,501 | 100 |
| 1725. | ATTCCACTCTGCTACAACAACAAT[G,A]ATGCCATAACACTCACTAAGAAACT | 597,547 | 100 |
| 1726. | GAGAAGATGAGGCTTAAGTTCATG[G,A]ATGCCATAACACTCACTAAGAAACT | 597,755 | 100 |
| 1727. | ATGAGGCTTAAGTTCATGGTCAAT[A,T]GACTTTAGACCAAGTGAGAGTTTAT | 597,761 | 100 |
| 1728. | TAAATTATCCATAAATCGTTCGAA[A,G]AaTTAACGGATGATGACACGTATTT | 597,930 | 100 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 1729. | TCGACAGTGTGGAGACACTGAAGC[G,A]AAAGTGTAGGTGCTTGATAGAGATC | 598,122 | 100 |
| 1730. | GTGTAAATAGTTCTTTGACTTGCG[G,A]TGCCTCGGTTGTTCACAGTAGGATT | 598,248 | 100 |
| 1731. | GAGATCCTATATAGTTTATGAAAC[G,A]GAGTCCTAAAATCCATGATCATGGT | 598,431 | 100 |
| 1732. | CTGATGGATTGCCACTACATACTG[T,C]TAGGTGTCACTGATGGATCATAAGA | 598,647 | 100 |
| 1733. | GATAAGAATGAGGAGGTTACATCT[A,G]AATTCAAATTTGAATTTGAATTTGG | 599,195 | 100 |
| 1734. | AGTTGGGCGACAACTACCCTATCC[G,T]TGGTGTACACCAATCTGAATTTCTC | 599,286 | 100 |
| 1735. | AGAGCCCTCCAATCATATCCACGC[A,C]TGTTCTCCCTCTTCTCTCTGATCTC | 599,489 | 100 |
| 1736. | CGGCTCAACAGCGAACCTCAAATC[T,C]ACGATCATCGGATTGCGGAGTTCAT | 599,783 | 100 |
| 1737. | CCATTGTAGCCGAAAGAAAAGATG[A,G]TGCATTAGTCCAGTCAGGAACAATA | 600,172 | 100 |
| 1738. | CAAGCAATTACTGATCATCGATTG[C,T]AGTCCATGAGCAAATATTCCCTCTT | 601,154 | 100 |
| 1739. | AAATTGACAATACAGACTATACAC[T,C]TAAATAACTAACTAAACAATCCCAA | 601,232 | 100 |
| 1740. | ATCAGTTAAAGACAATAAAAAGAA[C,T]AAAGCATTAGTAAAAaTAGCATTCT | 601,922 | 100 |
| 1741. | ATACTAACCATATCATGAAGATAA[C,A]AAATTTTCTTCCTGACAAACATTTA | 602,213 | 100 |
| 1742. | AATTAAGTCAGACTTGTTCAAGGA[G,A]AACAGTCCTTTTTAACTTCTTTACA | 604,520 | 100 |
| 1743. | CCTTTCGATAATAAGGACTAAGAT[A,G]GAGTTTAAAATTTCGCAAGAAATGT | 604,643 | 100 |
| 1744. | TGGTAAAAaTGAAAAGAAAAAaCC[T,C]AATAAGCTAAGTACCAGCTACAAGA | 604,782 | 100 |
| 1745. | CAGGGTTTTAAATCCCGTGGGACA[G,A]GGCAGTTCCAATTTTTTCATGGAAC | 605,107 | 100 |
| 1746. | CGGAATGCACTGCCGTCCTGTCCC[G,A]TCCCAATACTTGGGATAGAGGACGT | 605,156 | 100 |
| 1747. | CACTGCCGTCCTGTCCCGTCCCAA[T,C]ACTTGGGATAGAGGACGTCCCAATC | 605,163 | 100 |
| 1748. | TGGGACGGTCCTGTCCCAACACAT[G,A]GGATGGTACCCCATCCAAGTGTCCC | 605,231 | 100 |
| 1749. | CATCTGAAATTTTGGACATTCATG[A,G]TCAACAATGTGGATGATTGATTTCA | 605,495 | 100 |
| 1750. | ATCTAAAGGGGCCGAAACAAGAAA[A,T]TTTGATCTTTCAGCGTCAGATCATC | 607,187 | 100 |
| 1751. | TGAGAAAACAAAGAAATCAAAAGA[A,G]GACCTGTTAAAGGAGGTGAAAATGT | 607,237 | 100 |
| 1752. | ACATAaAAAACATTTTTTtCAGAA[A,C]CCAGCCACAACACAAACAAACCAAA | 607,441 | 100 |
| 1753. | GAGCGAGAGAGCAATAAATTAGGG[C,T]TCCCAATCTCTGTCGAGAGATTAGG | 607,787 | 100 |
| 1754. | AGCCATGTAACTTTATTCAGTGAT[G,T]TGTGTGTTTTATCTAATATTTTTGA | 608,455 | 100 |
| 1755. | CAACAAAAAAaTAACGAGAGATTT[A,G]TTGTGTGACTAATGCCTCCACATTT | 608,636 | 100 |
| 1756. | TGTGTGACTAATGCCTCCACATTT[C,T]TATTGATAGTCTTGATTATTTATTt | 608,662 | 100 |
| 1757. | ATTATTTTGAAACTTTTAGTTTTA[T,C]GTTGCCAACAATTTGCCCTCTATAT | 608,801 | 100 |
| 1758. | CAATTTGCCCTCTATATCTACTAC[C,T]GTGTCAATCATATTATATATATTCT | 608,834 | 100 |
| 1759. | AAAAAAaTTAATATATTTAACAAT[G,A]TATATATTATATCATGATAGTATAT | 609,035 | 100 |
| 1760. | AATTATTAGACATGCATAAATACA[T,C]AAGCAAAAAATCTCATGTACATATT | 609,126 | 100 |
| 1761. | GTCTGTTTCCTCTTTCTCATTGCC[T,C]TCATCCCCTCGCTCCAGTGGCGTAA | 609,401 | 100 |
| 1762. | ttCTTTGGGGTACAATAAACGAAC[A,G]TTAAAAAATAGGTGGACTTTGCGTT | 609,478 | 100 |
| 1763. | TGGAATACTTGGCTGTCCCCGTCC[T,G]CTGTCCGTAAATAATCATTGCTGAA | 609,555 | 100 |
| 1764. | TTTTCCAAATCGGATCCTATTTTT[T,C]CATTAATAACAAACCCTTGGAGAGA | 609,615 | 100 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 1765. | CAAATCGGATCCTATTTTTTCATT[A,C]ATAACAAACCCTTGGAGAGAGAAAA | 609,620 | 100 |
| 1766. | ATTAATAACAAACCCTTGGAGAGA[G,A]AAAAAATGCGAAGAGGTAGAATTTA | 609,641 | 100 |
| 1767. | TCCTTTTGGCCAACTAAGTATGAT[G,C]CTGCTACTAATTGGCAGTTTCTGCA | 611,000 | 100 |
| 1768. | ATAGAGGCACTTGATTTTTTATTT[T,C]GAGGGGGAGAGAGAAGGTTCAACGT | 611,687 | 100 |
| 1769. | CTATGGAAACATCTAGTGGATGTT[T,C]TTTACTTGTTGCTTGTTGGTATTTC | 612,132 | 100 |
| 1770. | TTGTTGGTATTTCATTGTGATTGC[A,T]TGCATGTATCTTTTGTTCAAGGAAT | 612,169 | 100 |
| 1771. | ATGAAGTTAACTGGTTAAAATGCA[C,G]AGGTCCAAGAGGAAATTAATGAACT | 612,563 | 100 |
| 1772. | TAAGCATCCAACTCTGGTTCTCTT[T,A]TATGTTCTGCTATTGGGAGTTGCAA | 613,414 | 100 |
| 1773. | TATCTGTTTCCTAGGGTAAGGGCC[C,T]TTTTTATGATTCTATTGAAGCAGTA | 613,509 | 100 |
| 1774. | CTTGCCAAAAATATTATTCTCATA[A,G]CCTGTATGTTAATAGAATTCTTTTC | 613,659 | 100 |
| 1775. | ATCTGTTGTTTCGATGACTGAGTC[G,A]ATTTCTTTCATGGCATCCATATACG | 613,755 | 100 |
| 1776. | CAACATCATTCCCATGCAGCAAAC[T,C]CAGGGAGCTTAAAGATAGACTACAT | 614,128 | 100 |
| 1777. | GAAATCATGGTGCACAATTTCTAC[A,G]AACATATAATAAAGCTGTTGAAAAG | 614,260 | 100 |
| 1778. | TGACATCAACTGGTGTATTTTGCC[A,G]GGTGAATGTGCAGGAACCAATTTAA | 614,780 | 100 |
| 1779. | CTGTCCTTTGAGCCAATCAAACTT[A,G]TACAGTGGAATACATGTCAAGTCTC | 615,082 | 100 |
| 1780. | GTAAAATCGGTTAAGTTAGTTACG[G,A]ATTTGCATGCAGATATGGAGGTATC | 615,605 | 100 |
| 1781. | TGTATATTTTTtATAAGTTGCTG[A,G]AAAAGGTCCATATATTGATCTCTTT | 616,087 | 100 |
| 1782. | CGCACAAGCTGATACACCATCAGA[G,A]GTGAGCCAACTTCTTATTTTACTCA | 616,336 | 100 |
| 1783. | GAGGCTCAAGGAACGTAAGGCAGA[C,A]AAGCCATTGTAAAGCCTCTGATAAT | 617,262 | 100 |
| 1784. | ATCAACACTTTCTTTGTCCTTTG[C,T]TACTTTTAATATTAACAAAACATAA | 628,883 | 100 |
| 1785. | ACTTAGGACCCATGCCAATCCTCC[A,C]GATAATATTTTTCAGACAAGGTTTT | 629,077 | 100 |
| 1786. | GCCTACATCTATTGTGATCCTCAC[G,A]AAATTGATGAGAATGGACCAGAAAC | 629,629 | 100 |
| 1787. | ACATCAATATAGGTGGTTTtTTTT[T,A]AAAAAAAAaaGAATTCATATTTTTG | 629,687 | 100 |
| 1788. | AATTCATATTTTTGTTTGTAAAAT[A,G]CAATTTCAATGGCATTTCATTCATA | 629,723 | 100 |
| 1789. | CTCCTAAGATTTCAAGGGAAAACA[G,A]TGGGGAAGAAACACACACTAGAGTG | 633,279 | 100 |
| 1790. | AGTCAAGAGGAGTCAACGGTCAAC[C,T]GTCGCGGTCAAAGTCAAAGTTTCCG | 633,581 | 100 |
| 1791. | TGTAAAAATATTATTGTACCATTT[C,T]TTTTGTTCTTGAGCAGGTAAATATT | 634,380 | 100 |
| 1792. | TTGTGATGTCATTTGGAAGGTTAA[A,T]GACTAGAGTTATTTGAGTTATAATA | 637,431 | 100 |
| 1793. | TTTGAGTTATAATAAGATCAGGAA[T,C]CCTATATTAGCAAGGAGAAGAAAAG | 637,467 | 100 |
| 1794. | CGAGGATTCTCTGCTAGCAGCTTG[C,A]CCCCGGGATCCAAGAGATAAGGTAG | 638,756 | 100 |
| 1795. | TTTCCTCCATTAAATTGCCTTCAG[T,C]ATTCGATTGTACACAAAGTTATAGA | 638,808 | 100 |
| 1796. | TTGTACACAAAGTTATAGACTTCA[C,T]CCTTGACGTCCAGAAGATCCAGGAC | 638,839 | 100 |
| 1797. | TCAAATATGGAGCTAGGGCTCCCA[A,C]AATGAAGGAAGAATCTGATGAATAT | 639,075 | 100 |
| 1798. | GCCGGAAGGCCTTGATACGGTGGT[T,C]GGTCATGAGCACGGAGTGTAGCTCC | 639,411 | 100 |
| 1799. | ACCGACCTGAATTGGAGGCTGAAT[A,G]TTGATCTGAATTGGAGGCTGAATGC | 639,979 | 100 |
| 1800. | TTTAGCTCATATAAATACCGACAT[G,A]AAGCAGAGTATTACATATATCCGAG | 640,163 | 100 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 1801. | AACTGGCTACGATCTCACGTACAA[C,T]TGTGCTATAACTCATCCCCAACTGG | 640,331 | 100 |
| 1802. | GCTTACTTACAGCTGGCCTCCAAC[G,A]GCCTAACAAACTCTATAGCTGGCCT | 640,435 | 100 |
| 1803. | CGGCCTAACAAACTCTATAGCTGG[C,T]CTCTAACGGCCTAACAAACTCTTCC | 640,458 | 100 |
| 1804. | CATCAGTCCCTCTATAAATAAAGG[G,A]CAAAGGGATCCTTCAGGTAAGTTTT | 640,516 | 100 |
| 1805. | TCTACTTTTTCTATCTTCTATTCT[C,T]GAGGCTCAAATTGACTTAAGCATCA | 640,673 | 100 |
| 1806. | TCTTATTTTGTAGGATTCTTCGAA[G,A]GAGACTCATATTGGATCACCACAGC | 640,759 | 100 |
| 1807. | TATTGGATCACCACAGCCTCTCCA[A,G]CATGACTTCATCCAATCTCTTCATC | 640,792 | 100 |
| 1808. | CTGAGATTTTGAGCCTCACAACAA[T,C]AGATTGGTGCTAGAGGAAGAGTGAT | 640,841 | 100 |
| 1809. | AAAAAGCACAAAGCAACTCTATAC[T,C]TTGACCGTCTCCCTCTGAAGATATG | 640,921 | 100 |
| 1810. | ACAAAGCAACTCTATACTTTGACC[G,A]TCTCCCTCTGAAGATATGCTGGAAG | 640,928 | 100 |
| 1811. | GCTGTCAACTCATGGTATTAATGG[G,A]GACGGCCCCCACATCCTGTGAGGTG | 641,166 | 100 |
| 1812. | TAAACAAAACTCATAACCTCTCCG[A,G]TAATAAATTCTCAAGCTCTATCTAC | 641,319 | 100 |
| 1813. | AAGAAAAAATCAAAACAAGAATAA[A,G]AAAaTTTATCCAAACGAGATATCTA | 641,418 | 100 |
| 1814. | TATCTATTTGAGGAAACTCAAGAT[G,A]CGATTTGAGATTTTAAGACAATATA | 641,462 | 100 |
| 1815. | GAAAAGAAAAAGAGGAGAAAATCC[C,T]CGGACATAGCCGAAGTCATCTTACA | 641,517 | 100 |
| 1816. | CACCCCATCGGATCGGCATCTTCG[A,C]CACTCCCGTGCGCCTCCTGGAGCCA | 641,664 | 100 |
| 1817. | CCAAGTGCCAAAACATCGTCAGAT[C,T]AGTGACTTCCCTCCGATCGAGACCA | 641,796 | 100 |
| 1818. | CGAGACCATCCGCATGCTCGTGTA[C,G]GTTTGCAGCACCAGgCCCTACCAAA | 641,838 | 100 |
| 1819. | GAGGCCCAGCACTGGCAAATCGAT[C,T]TCCAATCCTGCATCCTGATGGTGGG | 641,940 | 100 |
| 1820. | GGCTCCACTGGATTGACGGCCCCC[G,A]ATGATCTCCAGCTCTCCTCCCTGTG | 641,988 | 100 |
| 1821. | ATCTCTGGCTCTCCTTCCTACATC[T,C]GTGGGTATTTTCGGTGCCGAATCCA | 642,068 | 100 |
| 1822. | TTCCTACATCTGTGGGTATTTTCG[G,A]TGCCGAATCCAGTCAGATCGATTGC | 642,082 | 100 |
| 1823. | AAAAAaaaGAAAAAAAaGAaGAGG[A,G]GAGAGCTTGATCTCCAGCCAAAGTT | 642,559 | 100 |
| 1824. | ACAACAAGCAGTCAAGTAGAACTC[G,A]CAAGTTCTCAAACAACAACTCCTGG | 642,644 | 100 |
| 1825. | ATTCTTAAGCTTCCATTTGTTATT[C,T]TTTCTCTTTTCCTTCTTGCAGGATC | 642,700 | 100 |
| 1826. | AGCAAAAATAAGCTCGAATTGAGA[T,C]AAAACTTAAGTCCAAGCTGcGGCAA | 642,821 | 100 |
| 1827. | GAGATAAAACTTAAGTCCAAGCTG[C,A]GGCAAAGAATAGGAAGGAGTCAAAT | 642,841 | 100 |
| 1828. | AGCTGcGGCAAAGAATAGGAAGGA[G,A]TCAAATATAACTCAGAAGCTCTCAA | 642,860 | 100 |
| 1829. | TTCAATATTCGGATTGGTAGAGCC[T,C]AAATGGAGATAAGATCTCCTCAAAA | 643,364 | 100 |
| 1830. | AGATTGGTAGAGCTCCGAGAGGCA[T,C]AAATGGAGATAAGATCTCCTCAAAA | 643,434 | 100 |
| 1831. | TCCGAGAGGCATAAATGGAGATAA[G,A]ATCTCCTCAAAATCTAATCTCCGAA | 643,447 | 100 |
| 1832. | AAGATCTCCTCAAAATCTAATCTC[C,T]GAATTGGTAGAGTCTCGAAGGGCCA | 643,469 | 100 |
| 1833. | GAGATTATCTTCAGTTCTATAAAA[G,T]TCTAATCTAAAGGTCAAGATTATTT | 643,617 | 100 |
| 1834. | TTTGGATTTCTATCAAATACCGAC[T,C]TCAAGTCAAAGTTATATCAAAATTC | 643,665 | 100 |
| 1835. | AAAGGTCGAGATTATCTTAAATTT[T,C]TATCAAATACCGATCTCAAATCGAA | 643,772 | 100 |
| 1836. | TAACTTGAAATTCTATAAAATACC[G,A]ATCTGAGGGTCGAGGTTATCTTTAA | 643,824 | 100 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 1837. | CTATCAAGTACCGATCTGAGGATC[A,G]AGGTTATCTTTCAGTTCTATAAAAT | 643,918 | 100 |
| 1838. | TTTTTTAGTTCTATAAAATACTGA[C,T]CTGAAGGTCGAAGTTATCTTTTAGT | 643,989 | 100 |
| 1839. | GACCTGAAGGTCGAAGTTATCTTT[T,C]AGTTCTGTAAAATACCGACTTGAAG | 644,011 | 100 |
| 1840. | ATACCGATCTGAAGGTCGATGTTA[A,T]CATACAGTTCTATGAAATACTAATC | 644,170 | 100 |
| 1841. | GTTATCTTTCATTTCTATAAAATA[T,C]CGATCTGAAGGTCGATGTTATATTT | 644,231 | 100 |
| 1842. | AGATCGAGGTTATCATTCAGTTCT[T,A]TCAAATACTGATATGAGGGTCGAGG | 644,305 | 100 |
| 1843. | GATATGAGGGTCGAGGTTCTCTTT[T,C]AATTCTATAAAATATCGATCTGAAG | 644,339 | 100 |
| 1844. | CTATAAAATATCGATCTGAAGGTT[T,G]AGATTATCATTTAATTCTATAAAAT | 644,368 | 100 |
| 1845. | AGTTCTATCAAATACTAACCTGAA[G,A]GTTGTGATTGTCTTTTAGTTCTATA | 644,487 | 100 |
| 1846. | TCTATAAAATATCGATCTGAAGGT[G,C]GAGATTGTCATTCAGTTCTATCAAA | 644,696 | 100 |
| 1847. | GTTCTATCAAATATGGATTTGAGG[G,T]TCGAGGTTATATTTCAATTTTATAA | 644,735 | 100 |
| 1848. | TATCTTTCAATTCTATAAAATATC[A,G]aCTTGAAGGTCGAGATTATCTTTCA | 644,808 | 100 |
| 1849. | CATTCAGTTCTATCAAATACCGAT[A,C]TGAGTATTGAGGTTATCTTTCAATT | 644,893 | 100 |
| 1850. | CTTGAAAATATCAACCTGAGGGTC[A,G]AAGTTATATTTCAGCTCATATAAAT | 645,057 | 100 |
| 1851. | AGCTCATATAAATACTGACCTCAT[A,G]GTCGAGATTATCTTTCAGCTTATAT | 645,094 | 100 |
| 1852. | TGAGGTTTTACTGACCTCAAGATT[A,G]AGGTTATCCTGCAAAATACAGATCT | 645,319 | 100 |
| 1853. | CCAATCTCCAGATTGGTAGAGCTC[C,T]GAAAGACACAAACAAAGATCAGATC | 645,525 | 100 |
| 1854. | CTATGGATCGATATTATCTTTCAG[C,T]TCGTATAGATACTAGTCGACCTTAG | 645,589 | 100 |
| 1855. | GCTCGTATAGATACTAGTCGACCT[T,A]AGGGTCGAAGTTATTTTATTATTCT | 645,612 | 100 |
| 1856. | TGATCTCCAGATCGAAGTTATCTT[G,A]AAATTCTATTATCGATCTTCGAATT | 645,708 | 100 |
| 1857. | AAATTCTATTATCGATCTTCGAAT[T,C]GAAGTTATCTTGAAGTTCTATTAAA | 645,733 | 100 |
| 1858. | CATCTCAGCTCATAAGAAAGCCGA[C,T]GTGAATCAAAGGCCAAGTTTACATA | 645,967 | 100 |
| 1859. | GAAAGCCGACGTGAATCAAAGGCC[A,G]AGTTTACATAAAGTCGATCTGAATT | 645,982 | 100 |
| 1860. | AGATGTTCAGGGTCCCATATGATA[C,T]TTGATTTCATTTTGGTATTTTATCG | 646,515 | 100 |
| 1861. | CTCCGTCTGAGATTTTGAGCCTCA[T,C]AGCAACAATAATAATATAATATAAT | 647,142 | 100 |
| 1862. | CGAGGTGGTTTAGCTCTTCATGGG[A,T]ATAATAACAAATTGTTTCTAACCAG | 649,436 | 100 |
| 1863. | TCATTCATAATATATCAAAGCAAC[C,T]AGAAATCCTACTGGTTCGGTCCAAT | 649,836 | 100 |
| 1864. | CATGTTAAAAATACCCTTGTATTC[T,G]GCTTAATATAAACTTaTCTCACAAT | 649,909 | 100 |
| 1865. | TTGTATTCTGCTTAATATAAACTT[A,G]TCTCACAATCATTTTTCAGTAAATT | 649,925 | 100 |
| 1866. | TTAATATAAACTTaTCTCACAATC[A,G]TTTTTCAGTAAATTAACAATGATAA | 649,936 | 100 |
| 1867. | ATATGtAGGGGTAATCAGAAGAAA[T,C]GAAaGATGTGTCGGTACTCTGGTGT | 649,985 | 100 |
| 1868. | TCAGAAGAAATGAAaGATGTGTCG[G,A]TACTCTGGTGTCAtgCATATAGAAA | 649,999 | 100 |
| 1869. | TTTTTATTCAAAAAAAaTATTTTT[A,G]TTTGTTTATTATTCTATTTTTCTCT | 650,084 | 100 |
| 1870. | TATTCAAAAAAAaTATTTTTATTT[G,A]TTTATTATTCTATTTTTCTCTGCTC | 650,088 | 100 |
| 1871. | TACAGAATTACCAAAAATTTTGCG[A,G]CCATTTAGTTCTTCTTTCAGTATAA | 650,786 | 100 |
| 1872. | ATTACCAAAAATTTTGCGACCATT[T,A]AGTTCTTCTTTCAGTATAATTTCTG | 650,792 | 100 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 1873. | ACATGGTGCCTCTTGCAAGTTGAT[G,C]AAAGCCAAATTGACTAGCATTATTG | 650,948 | 100 |
| 1874. | AAAAGCATGAACTCTTACACCATG[C,T]ACTCGATCCTGATTACCAGTTCTAA | 651,003 | 100 |
| 1875. | TTTGATGTGATACCAAAAATGTCA[C,T]GCCACCACTCCCCTCTAATTTAACA | 651,160 | 100 |
| 1876. | ACGGGGTTCACTTGATTCCACAGT[T,A]ATCGTACCCTAGTCTACAGTAGAAA | 654,644 | 100 |
| 1877. | CTTTTTTGTTCATCTTTGATGCGT[A,G]GTAGACACAACTTTTTTGAGAATTG | 655,763 | 100 |
| 1878. | TGATCTTCTCTTTGCTTTCTTGTG[A,G]ACGATATGGAATTTTGATGACAGCA | 655,849 | 100 |
| 1879. | GAAGGAATGGTTCTTTTATGTCCC[T,C]AGAGATCGAAAGTATAGAAATGGTG | 655,916 | 100 |
| 1880. | GACGCTTGTCTTCTACTCTGGGAA[A,G]GCTCCTAAAGGCATACGATCAAGCT | 656,063 | 100 |
| 1881. | TTGAGCTAGCTTTTCATATCTGAT[G,C]TTTTCTCTTAAGTCAACAAGAAGGA | 656,718 | 100 |
| 1882. | ATTTTTCTGTTGCTCTTTGTGAAC[C,T]AAGCTTACTGTTTtAAATTTCTTCT | 656,925 | 100 |
| 1883. | CTTTGTGAACcAAGCTTACTGTTT[T,C]AAATTTCTTCTTCTTCATCATGTCG | 656,939 | 100 |
| 1884. | TTTGCAGACCGAAATCTCGCTCTG[C,T]CGAGTCTATAAAAGAGCTGGGGTCG | 657,331 | 100 |
| 1885. | TCCTCCTCATATTTTtCTTTtCTT[T,G]tCTTTTCCAACAAAGACTGCTGAAG | 657,997 | 100 |
| 1886. | TGTAACTGTGGGTGAAAACTTATT[C,G]TAGATCAGGTTTGTAGTTCGACTAA | 658,049 | 100 |
| 1887. | TTATTCATATATACGTTCTCATCA[A,C]TGAATTTAGGGCATTTTATCATCTT | 658,495 | 100 |
| 1888. | TTCATATATACGTTCTCATCAaTG[A,G]ATTTAGGGCATTTTATCATCTTCTA | 658,498 | 100 |
| 1889. | TTTTATCATCTTCTAGGGTCTCTT[T,C]TGGTTTGGCATGTATTTCCTAAACT | 658,533 | 100 |
| 1890. | TGGCATGTATTTCCTAAACTGGAA[A,G]TATTTCAGATCAGTAGTTGTGAGAG | 658,563 | 100 |
| 1891. | ATTTCAGATCAGTAGTTGTGAGAG[G,C]AGATTCTTAGTCTATATGTGGTATG | 658,589 | 100 |
| 1892. | TACGGCCTAGCTATGTAtaGATCT[G,A]GCGTTGCTTCTCACTTTGTTCACTT | 658,866 | 100 |
| 1893. | CCTTTCTTAACTTGGATATCGTTT[T,G]CTTCTTTGGGCAGTGTTTTAGATTT | 659,156 | 100 |
| 1894. | TCTTTTGGTTCCAGATGTCTTGCT[G,A]AGCTTGGGCAATCTCTTAGGTTAGT | 659,326 | 100 |
| 1895. | TCAAAGATTGCGACGATCGATAAA[T,C]CTGTTCTAGACCATGTTCACTCACT | 659,667 | 100 |
| 1896. | TCGACGAAGAATGGCTTTCGGAGA[A,T]AGCTGATCTACTTCACATGAACTTT | 659,889 | 100 |
| 1897. | ACTTCACATGAACTTTCATTTATG[A,G]TCATCTGATCCAGGTCCAACAGTGA | 659,923 | 100 |
| 1898. | AACAGAAAGAGTATATATGACTGT[A,G]AAACTCTCAATTAGTGAGATTACTT | 660,011 | 100 |
| 1899. | TCCATCTTTATTAGCTCCATGAAT[C,G]ATGCACTATCATCATGTCAATATTT | 660,636 | 100 |
| 1900. | ATTAGCTCCATGAATCATGCACTA[T,C]CATCATGTCAATATTTATTATTGTA | 660,645 | 100 |
| 1901. | AGTTTGAAAAGATGAAAAGAGTA[T,C]CAGAACCAAGAAAAAAaTGAACGAG | 660,739 | 100 |
| 1902. | CAAGAAAAAAaTGAACGAGTCTCT[G,A]AATTTTTAGAATATTTTAGAAGAAG | 660,770 | 100 |
| 1903. | GGCAATTTTAATCAGAAATAAAAA[A,G]AAaTCAAAAATTTGCATGATTATGA | 660,819 | 100 |
| 1904. | GAGAGGCTGCTTCACTTCTTCACC[T,C]GTTCAAAACAATACAGGATATTTTC | 660,946 | 100 |
| 1905. | ACCTGTTCAAAACAATACAGGATA[T,C]TTTCAACTCACACATCTAATTGAGC | 660,967 | 100 |
| 1906. | TCGGGGAAGTTAGACACCAGAAGG[C,A]GAATAGAAATGAATCTCCTATTCTA | 661,063 | 100 |
| 1907. | TATATTTAGGATTATCAGATAGAC[C,T]TTTTTAGGCAACATTGAGCTAGACA | 661,351 | 100 |
| 1908. | AACATTGAGCTAGACATCCAGAGC[C,A]ATGAGAACTCACAGGACGGAACCAA | 661,385 | 100 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 1909. | GATTTTGGAGCTAGACCTGCAACC[A,T]GATCTACTCCAAGTCCAAATAAGGT | 661,851 | 100 |
| 1910. | TACTCCAAGTCCAAATAAGGTTGG[A,C]CAGATCCTGGCCCAAGCTCAACCCG | 661,880 | 100 |
| 1911. | CAAATAAGGTTGGACAGATCCTGG[C,T]CCAAGCTCAACCCGACTGTTTCCAG | 661,891 | 100 |
| 1912. | AGAGAGAGACAGGGAGAGTTTTGT[G,A]GGATATATCGGTTTTATTTGGTAAA | 661,976 | 100 |
| 1913. | TACCTCATTCAAGAGATGTAATTG[G,A]TCGATGATGTATATAATTATAACAT | 662,029 | 100 |
| 1914. | GAGATTAATGTGCCATGCCATACA[C,T]CTGTGAGATTAACAGTGGATAGACT | 662,111 | 100 |
| 1915. | CTCACTAGTTACATTTGTTTGGCC[A,T]AGGCCCTTGTCAGGCACTAGTAACT | 662,159 | 100 |
| 1916. | CTTGATGTTAATGAGGATCGCATA[T,G]ATAAGCATGGGTAATCACATAAAAT | 662,615 | 100 |
| 1917. | TGATGTTAATGAGGATCGCATATA[T,C]AAGCATGGGTAATCACATAAAATGT | 662,617 | 100 |
| 1918. | ATTTGCTGTTTACAACTCACATTA[C,A]TAAATCACTGTAACAGCTCTCTTTT | 663,349 | 100 |
| 1919. | ATCCATTGTAGAGTCCCACAAGAT[G,C]TCGTACAACAGAGATTTTTTGGTAA | 664,398 | 100 |
| 1920. | TCAACCATGCATCATTGTTAGATA[C,A]TAGCCTATTTAGCCAAGCTACGAGA | 664,591 | 100 |
| 1921. | AACCTACAGTAGCTAATATGCCAT[G,A]ACCAGTGTTTTGTCTTAAAAACATT | 664,778 | 100 |
| 1922. | AAGTGAATAAGAAGAAAAAATGTG[G,A]GAGGAAAACTAACATAATAGGCTGT | 664,878 | 100 |
| 1923. | ATAGGCTGTATAAGCTTTAAAGAG[A,G]CCCTAAGAAATATTGGTGAACATAT | 664,919 | 100 |
| 1924. | CACCAAGGGAACCCCCAATATCAG[C,T]CCCAGGTACCCATCCAAGGAGAGCC | 667,196 | 100 |
| 1925. | TGATTGTAGAACTCTTGAAATTGC[C,T]GTAGAAGAGGCTGGTTGAACCTTAT | 667,291 | 100 |
| 1926. | TTTGGCCCAGACTAGATTGGTCAA[G,C]GCCTCCCCAACAGCCAACCTTGCCA | 668,460 | 100 |
| 1927. | GTTCAGCAAACCCTTTATTGGCTG[C,G]TCCCCAATGGCACAAGCACCACCAG | 668,520 | 100 |
| 1928. | CTTCACAACATTACAATTTCCCCC[A,G]GCTCCCTGATCATGAATACTGATGA | 669,132 | 100 |
| 1929. | GCCTCTCTTCCCTTCTCAATGACA[G,T]GAACCACACTAATAGCCTCTGGAAC | 670,165 | 100 |
| 1930. | ATAAACACACTCTGTCATTCTATC[C,A]TGAACCATAGCTGCAAAATCATTAA | 670,248 | 100 |
| 1931. | CAAGAATTTGTACGCAGAAGAAGA[T,A]TAGGCCTCCTTGATCCCTGGAATAG | 670,894 | 100 |
| 1932. | TAGGCCTCCTTGATCCCTGGAATA[G,C]ATAAAGAAGAGATTCCAGAACAATT | 670,919 | 100 |
| 1933. | GCTCCTTGCCTGGGAGTCCCAGAT[G,T]TCCATGTTGCATGTACCATATTTTt | 691,787 | 100 |
| 1934. | ATGTTTATACAGTTGCAATCTTTC[C,G]TTGAGGATAGAACAAAAACTGTAAA | 691,391 | 100 |
| 1935. | ATTTATGATTTAGCTGCCAGAGAT[A,G]GTGGACAATCTAATAACCTGTTTGC | 692,492 | 100 |
| 1936. | TtTTtCTTTtCTTTTCTCTTTtTT[T,C]GGTTGGTTTAAGATGGGGAGTTCTT | 692,876 | 100 |
| 1937. | GAGCATGTGCAAGAGGGTCTTGTT[A,G]GCTGGGCTGAGAAGGTAAAGAGGAG | 692,946 | 100 |
| 1938. | ATGCAATCCATCAATTGGCCAGCA[A,T]CTATGATACTATAACTTATATATCC | 693,145 | 100 |
| 1939. | CTAGTCAGGTGCTCAATGTTATAT[T,C]GATATCCAAATAGATTCAGATCCCA | 694,257 | 100 |
| 1940. | TTTGAGCAATCAAGAAGAGTGTAC[G,A]CACTTAGCAACAACCCCTACCTTCA | 694,298 | 100 |
| 1941. | AGAAAGAAGACTGGGATGAAGAA[A,G]aAAGTGGTCTCCCTATTTCAAATAT | 699,190 | 100 |
| 1942. | GAAAAGAAGACTGGGATGAAGAAa[A,G]AAGTGGTCTCCCTATTTCAAATATT | 699,191 | 100 |
| 1943. | CTTCCATTTTCTTCTTGTCACTTC[C,G]ACCCAAGTTTTTCTTTCCCCCTTTC | 701,712 | 100 |
| 1944. | TCCTTTTTATTAAAACAACTTATT[C,G]AAGTAGTCTACAAGTACGTTAGGTG | 702,566 | 100 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 1945. | GGTGCAACTATGACAGTACAATAA[C,A]AATGGCGATGTTCCTTTAAGTCAGC | 704,049 | 100 |
| 1946. | GGGAGTTGACAAAAATACAGGGGG[A,G]AAATGATGGACAAGATATTGGTTGT | 705,206 | 100 |
| 1947. | TAATATTATTAAAATTTTTtAACA[G,T]AATAGTTCACGTAATTTACATATAA | 705,411 | 100 |
| 1948. | CATATAACTCTTCTTATATCTGAT[A,G]TGGTATAGTTCAAGAAAAAAAaaa | 705,454 | 100 |
| 1949. | CTGATGCCGAAACCCTAATTTTTA[A,G]CGATTTTCTTTTGGCAGATATTtCT | 705,635 | 100 |
| 1950. | CAGTCTTAGCTCTCATCCTTATCT[G,A]AAATTTTTTAAAAAAGTTTGTCCTT | 706,275 | 100 |
| 1951. | AGCATAAAACCCGTGCTACATTGT[G,A]GgTTTTAATAAATAGAAGACAGAGT | 706,516 | 100 |
| 1952. | AATTGATGTTCCCTAATCTGAAAA[C,T]ATAGTTGGAAGAATAGAAAATTAAA | 706,692 | 100 |
| 1953. | TAACCCTAGCCCCAACCCTAACCC[T,G]AACCCTAACCTTCAAAAATCTAACT | 707,153 | 100 |
| 1954. | CGATTTTTCTTATCTGCTGCCACC[A,C]TCTTCGATCTTTCTAATCCTCAATA | 707,898 | 100 |
| 1955. | ATAAGATAATCCATGCTTTGGCAT[C,T]AATATTTTTGATTTTTCTCAAAA | 708,098 | 100 |
| 1956. | CAGATCGCTATCTTCTTTTTCAAA[C,T]GAAGCATCATATTTTTtCTACATGC | 708,397 | 100 |
| 1957. | TCATACTACCCCCTTTCTGTGCCT[C,T]CTCCTCCCTTCCATCCGGCTCCACC | 710,065 | 100 |
| 1958. | AGGTGGAGCACAGCGACTAGGGCA[C,T]TGTCGAGGCATCCTTCTTCCCATGC | 711,592 | 100 |
| 1959. | CGGGCGGTAGGGGTACAGTCTTGA[A,G]GGCAcGGGAGAGGGAGCAGGTGGCT | 711,750 | 100 |
| 1960. | GGTAGGGGTACAGTCTTGAAGGCA[C,T]GGGAGAGGGAGCAGGTGGCTCCGAT | 711,755 | 100 |
| 1961. | GCCGATCTTTAGGCGGTTCTTTGG[A,G]TTGTGTTGAGCCAAGAGGTGAAGCA | 711,931 | 100 |
| 1962. | TGGGATTATTGAGATTTTGGCGGG[T,G]GTAGAGCAGAAAATCGAGGCCGAAG | 712,822 | 100 |
| 1963. | TTTGGCCCGAGCCCAGCCTAAATG[G,A]TTTTGAGCCGAGCCCAAAGCTTGAC | 713,397 | 100 |
| 1964. | GTGAAGAAGGAAAATAGACTCTTA[G,A]AAAATTGTGCACTTCATATTTCTTC | 715,214 | 100 |
| 1965. | AGAACGAAAAATTCATCGAACTAC[G,A]CTATTTCTTGGAGAAGTGCCAAAAA | 716,031 | 100 |
| 1966. | ATCCTCGGATCGATCCAACCGACA[C,T]CCGACTCTACCCACCGGACAGACAG | 716,177 | 100 |
| 1967. | CACCTTGTCCGAAGGATGGGTTCG[G,T]ATTATTCTTTCCCTATTGGTAATTC | 717,500 | 100 |
| 1968. | AGAGAAGTGCATAAGGATTGATTC[A,G]TTTGAAGCCAAGTAGGCCTTATTGC | 718,659 | 100 |
| 1969. | AAAGGATTGTCTCAAATGGAGCAC[A,G]TGATTTCACAAAGGTGACTTGTCAG | 721,006 | 100 |
| 1970. | TTCTTACTATTTTGATTCCCTTGC[A,G]TATATAATCTTAGCAATCATTGTAT | 721,146 | 100 |
| 1971. | CTGGAGTAGCAAGAGATGCTGTAC[C,T]GGAGTTACTAGGTTTCTTGGTGGAG | 721,828 | 100 |
| 1972. | CACCCATTTTTAAAAGAGAACATG[A,G]CATTCATAAAATGGGGCAGACAGGT | 722,331 | 100 |
| 1973. | GATGCAGCAGGAAGAAAGAAGAAA[C,A]AAAACAAAaATAaAAAACAATCAAA | 723,920 | 100 |
| 1974. | TTATTTGGAAGAGGTTAAGGTTAA[C,T]GGCGATGATTTATCATCATAAAATA | 731,383 | 100 |
| 1975. | AGCTTCTTGGACAAAGGAAGATCT[C,T]CTTAGAAACTAGTCTTGATTTTCCT | 731,600 | 100 |
| 1976. | GCTTCTTGGACAAAGGAAGATCTC[C,A]TTAGAAACTAGTCTTGATTTTCCTT | 731,601 | 100 |
| 1977. | TATGATCCACTACATGGAATAGTT[T,A]ATGAAGCAAGTAATGAGTATTTACT | 732,394 | 100 |
| 1978. | ACTACATGGAATAGTTTATGAAGC[A,C]AGTAATGAGTATTTACTTCTTAGAG | 732,402 | 100 |
| 1979. | CAAGTAATGAGTATTTACTTCTTA[G,C]AGTTAGAGCAGTGCCGACAATGGAA | 732,425 | 100 |
| 1980. | TCAAACCATAGGAGCGCAGGATAC[G,A]CTCAGCAACGAGACAGCCAACAAAT | 732,587 | 100 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 1981. | TAAATTCCTCTCTGACGTGGGACT[T,C]TAAGGTTCTTGCAAACTTGAGTTTG | 734,317 | 100 |
| 1982. | CAAGGAAACTGGTAATCCACTGCT[A,G]TTGAGAAGGAGATAGCCTTCAACTT | 734,505 | 100 |
| 1983. | TCAGTCCAAGAAAATTGAAGATCT[A,T]ATTTTCAACAACATATTATGTGGAA | 734,598 | 100 |
| 1984. | CAGTCCAAGAAAATTGAAGATCTA[A,C]TTTTCAACAACATATTATGTGGAAA | 734,599 | 100 |
| 1985. | AACACAAACTGGGCTCTTGGAGTT[G,T]GAAGAAATTAACATGCAGGCAGTTC | 734,720 | 100 |
| 1986. | AATGGATGGAAAaTAAAAAaTTC[T,A]ATCCTTCCCTCTCAGCCTTTGGCTT | 734,847 | 100 |
| 1987. | ATCCAGAGCACATGTAAATAATAG[A,G]CACCCAAATGCTTGTGTAGGTTCAA | 736,155 | 100 |
| 1988. | TCATGGCACGAAAGGCAACCAAGC[A,G]aCGGTGCACCTACCAGAACAGCGCA | 744,082 | 100 |
| 1989. | GTTAGATTTGAAAAATAGATCCCA[T,G]ATTAGATTAGTATATTTGATATAAA | 744,165 | 100 |
| 1990. | AAAAATTAATTAAAGATGATAATA[T,C]TATCTCAATATTAAAAAATTATTTT | 744,477 | 100 |
| 1991. | GGAGCAGAAGAAGTTGCCGACTTA[A,G]ATTATTCTCCTAAAACATGACCAAT | 744,795 | 100 |
| 1992. | ATTCTCCTAAAACATGACCAATAT[C,A]TAACATCCGAACGCTGGAAATAAGA | 744,823 | 100 |
| 1993. | ACTAACATGAAAGATTTTAGGAAT[G,A]AATTTGCAAAAACCGTTTCTTATTT | 744,989 | 100 |
| 1994. | TTATAGCTATCGTTTTGAATATAT[A,G]ATAAATAAATAAATAAATAAATAAT | 745,092 | 100 |
| 1995. | AATAAATAAATAAATAAATAAATA[A,T]TTTTTATATATAATAAATATAAATA | 745,116 | 100 |
| 1996. | TCTAATATCCAACTGTTTAGCACC[A,G]TTAAATTATTCCAAAATGTTGGAAT | 745,226 | 100 |
| 1997. | CCATTAAATTATTCCAAAATGTTG[G,A]AATTGTGACTATGACGTACCAAACT | 745,248 | 100 |
| 1998. | GACTATGACGTACCAAACTAAATT[C,T]GAATTCGAATCTAATTTTATTCTGA | 745,279 | 100 |
| 1999. | TTAAGTCTCTAAATTTTTtAAATT[A,G]AATAAAAAATCTCTAAAATATTAGC | 745,422 | 100 |
| 2000. | TATTTTTAAATTCCTGTCGTCTAC[G,A]TAGATTGATTACATAGGTCTATGTT | 745,476 | 100 |
| 2001. | ATAGGTCTATGTTTAGGTTACACG[A,G]ATTTATGCTCAAGTTACACAGATTT | 745,513 | 100 |
| 2002. | TAGGTTACACGAATTTATGCTCAA[G,A]TTACACAGATTTATGTTCAAGTTAC | 745,526 | 100 |
| 2003. | CGAATTTATGCTCAAGTTACACAG[A,G]TTTATGTTCAAGTTACACAAGTTGC | 745,535 | 100 |
| 2004. | ATTTGTAGGTATTGTGCAGATGAT[A,G]TTTTGGTCTATGATTGATGGATTTA | 749,100 | 100 |
| 2005. | ACATATAAGCATGAACCTGATACA[A,T]GAGAAACTTAGAATAATGGTACTAC | 749,792 | 100 |
| 2006. | GTTAAAGTCCTTGCTGTTGACATG[T,A]AAATAAATGCTGACTGCTTTGTATG | 752,010 | 100 |
| 2007. | CAGTTCATCAAACTTTTGGACACC[A,G]GTGGTTATAACTTTACAATTCATCA | 752,170 | 100 |
| 2008. | AATTCATCATCCTTGACCTTTTTC[A,G]aTAATTAAATTAATAATTGTAACCA | 752,211 | 100 |
| 2009. | TATTTAGAGCAATTAGTGGATCTA[G,A]TTGTCCTGGTCATTTATGTCAATTA | 756,570 | 100 |
| 2010. | ACCTTGCAGGTACGTGGCATTTGT[T,C]ATGCTTTGGGTTTGAAGCGTGATAG | 756,835 | 100 |
| 2011. | AAAACATTGAGGGCCTATAAAAGC[C,T]CTAAAATAAGGTATGGCAACATTGA | 756,935 | 100 |
| 2012. | ACATTGATCTAACTAAGCCCTGTT[C,T]GGCCAAGGTTGGTTCAGGGGTTTAC | 756,978 | 100 |
| 2013. | GGTTCAGGGGTTTACAATTTTGAC[C,T]GGGTTGGAGTAGATTTTTATTAACC | 757,013 | 100 |
| 2014. | CTTTAAAAATGCTAAAGCATCCAT[G,A]TATAGGCTCTGTTTAGGTAATCTTG | 757,688 | 100 |
| 2015. | TCCATATAAATAGGGGTGTGTACT[A,G]AaTCAGAACAGGTTTTCCTCAAAAA | 757,741 | 100 |
| 2016. | CCCAGTCTTCATATGTTAAATATG[T,C]GGCTTAGTTGGTGATTCGAGCAAAA | 757,861 | 100 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 2017. | GGTCTCTAATCATCAGATTGGAAG[G,A]AAGAAAATAGAAAGCAAAAATACTG | 758,002 | 100 |
| 2018. | TGATGATATGTGATCATTTCTGTC[A,G]TGACTGTCGAATAGAAATATTTTA | 758,144 | 100 |
| 2019. | ATGGTTTGATTATAATTAATTGAA[A,G]TTTAGAATAAACATAAAAATCCTAA | 758,199 | 100 |
| 2020. | GAATAAACATAAAAATCCTAAAAG[G,A]TTTAGAGTTTTTGGCGTAATTAAGT | 758,228 | 100 |
| 2021. | TTTGGCGTAATTAAGTCTTTTTTT[G,A]TGCTTATATTTTACATGTTGGATTC | 758,262 | 100 |
| 2022. | TCTTCTCTCACAAAAAATCCTTCT[A,G]TCAAAACTTCTACCACAGCATGGAG | 763,780 | 100 |
| 2023. | GTAGGTGAGGAGGAGTTTGGTGGA[G,A]AGGATGGCGTCGGTGTAGAGGCCAG | 764,178 | 100 |
| 2024. | TGCCTTAGCCACCCTAGTTGCCCA[C,A]AAGCCAATAGCAAGCTGACCATGAC | 764,705 | 100 |
| 2025. | TACTTCCCAAGCTTGATCCACATC[C,T]AATGCACAATCCAGAGAAAAGCATC | 766,025 | 100 |
| 2026. | GACTTCCAAAAATTTTCATGGCTT[G,T]TTAACTTGTTTCCAAGAAGATGGCT | 766,218 | 100 |
| 2027. | CAGGCAACTGCAGATATTTAATTT[G,T]TTAACTTGTTTCCAAGAAGATGGCT | 766,390 | 100 |
| 2028. | TTATTTGCATGATGCAATTTCATC[G,A]TCTTGCTTTTTGATGTTAACTTGAC | 766,970 | 100 |
| 2029. | AAAAGCATGCGATTACAATGAGCG[A,T]CTGTCGGTAACAGCCCTTGAATACT | 767,172 | 100 |
| 2030. | ATATGGGAAGCAATAAAAGCATGC[G,A]ATTACAATGAGCGACTGTCGGTAAC | 767,186 | 100 |
| 2031. | AACTTGTTTATTTTGAGAATTTGC[A,G]TAATTGAGATTTGACAGATTAATCA | 768,299 | 100 |
| 2032. | ACGTCCTGTTGGTCTACATTACCA[C,T]TTGAAAATTCCACCCAAGAAAATCA | 768,624 | 100 |
| 2033. | ATATATTCTGAAAGGTTAAAATAG[A,G]CAACAGCAATATTGGTATCTAGCAT | 771,000 | 100 |
| 2034. | AAGTCAATAGTAAAATGACTAAAA[G,T]AGATTTTGAAGTATCATGGCAAAAT | 771,070 | 100 |
| 2035. | GAGGAAGAAGAGAAGAGGAAGGAG[G,A]AAAAAAATGGAGCACTACTTTCAAA | 771,249 | 100 |
| 2036. | AAATGTTAAATGATAGTGTTTACT[A,G]CAACACTTCTTTAATAATATTTTAT | 771,906 | 100 |
| 2037. | CAAGGGGAGTAGAAACTTAGGAAA[T,A]ACATTCAAGGCTTCCGCGGGAGGAG | 772,264 | 100 |
| 2038. | GACGTGGCTGACGTCCGGGCCGAG[G,T]GCTAGGGCTTTAAGAGATTCTAGGG | 772,414 | 100 |
| 2039. | AAGAGGACCTCTCCGGAATCGACG[T,C]GGCTGACGTCCGGGCCGAGGGCTAG | 772,434 | 100 |
| 2040. | CGTATCCATCGGCGGTTCTGGAGG[C,G]GAGCCGTTCGGAGGAGAGGCCGATG | 772,511 | 100 |
| 2041. | CACCCTAGACATCAGCTGCTCAAA[C,G]AAAAGAAAAACAACTCCTAAATTTA | 772,791 | 100 |
| 2042. | TAATTTTTTTTttAAAAAAAAaGA[C,T]AGGTAAAAATTCAAGCAAAGAGGAC | 773,145 | 100 |
| 2043. | ACTACCTTGCATCAATCTCTACTA[C,T]CAAGCCTGAAATAAGCCAATGAAAT | 773,657 | 100 |
| 2044. | TCAATTTTAGTGCCTTACTTCACT[C,T]AGGCGAGCGCTTTTCTGACGCCCCT | 773,770 | 100 |
| 2045. | TTCATGTTACAATAGTTATCACTA[G,A]TTGTTATTTATTTATATATCATACT | 773,834 | 100 |
| 2046. | CCAATGAAGGAAGAGAAGACGAAA[G,C]TGATGACAACTTCGCAAGTGAAACT | 774,151 | 100 |
| 2047. | AAaCCTAAAAGACCGCCCATTTAA[C,T]TTCTCAGCTCCATTACTAACAGGGG | 774,291 | 100 |
| 2048. | TtTTTtAATGACTGAAAAGTGTAA[A,G]AAaCCTAAAAGACCGCCCATTTAAC | 774,316 | 100 |
| 2049. | CACCTCAGACGCTCAAGTGAGGTG[C,T]CAGAAGGGGTCACCACCCCTTGATA | 774,473 | 100 |
| 2050. | AATATATGCCATCAATCCAATGAT[G,A]TCAAAAGTGCCAAAAGGCGCACCTC | 774,517 | 100 |
| 2051. | AATTTCAACTTAAAAAAGTGCCAG[T,G]TACAGAAAGCAAACAACTCAAGGCT | 774,679 | 100 |
| 2052. | TGGCATCTACCTATTTAAAAAGTT[C,T]AGAAGGAAAACCTGCACACAGCCCC | 775,516 | 100 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 2053. | TATAAATCTCTAATTCTATTTCTT[C,A]ACTTGATCGAGCCCATAAAATTAAT | 775,916 | 100 |
| 2054. | CTACGAATGAATTGGCCCAAGGCC[G,A]GGATGTTGCTAGGCCTTGTCATTAG | 776,126 | 100 |
| 2055. | GAAGGATGGGCCAACCCGTGCTTG[A,C]CTGGAATTTTTATATTGTTCATGAT | 776,218 | 100 |
| 2056. | GACATTTGTACCTCTATATTGCAT[G,A]CTAATCCATGTTGATTCACGTTAAGC | 776,648 | 100 |
| 2057. | CGCTACAAAACAAGCATCTAACAA[C,G]AAGTCAAAAGCAATCAGAAAAAACC | 776,852 | 100 |
| 2058. | ATTTTGTGTGCATGACTCAAACAA[A,C]TGCCCATATTGATCTTCACATCCAG | 776,981 | 100 |
| 2059. | TGATTCGGATTCGGATTTTCTTAC[G,A]ACATTCAGGTTGAGTTCACATTCAT | 777,788 | 100 |
| 2060. | AAATTAAAACAATATGAAATAATT[C,G]TAGAAGTAACAATATCTTTGAAATC | 778,657 | 100 |
| 2061. | CATCAGGAGGCAAACACAACACAA[T,C]CATAATTCCCCTAGTCTGGCTATCA | 778,984 | 100 |
| 2062. | CTTCCCCcTCTCTCTTCCTCTCTC[A,G]TTCTCCCTTCACCCTCTCTCTGTGT | 779,535 | 100 |
| 2063. | TCAATAGTGGTGCAGCAAGCTCAA[C,T]TGCCCTCCGGAGTCCCTCTCTCCTT | 779,596 | 100 |
| 2064. | AGGAGGGGCTCCGCCCTCTTGATC[A,G]AAATAGGGGCTTCGGTCTCTGTTTC | 779,885 | 100 |
| 2065. | AGGAAAGGAAAAGGAGGTTCCCCG[A,G]AGGCCTTTGGAGGGCTAGCAAGGCC | 779,965 | 100 |
| 2066. | CTCAATATAACTGAATATCAGAGG[C,T]GGAACTGCAAACAACAACCTATTCT | 780,454 | 100 |
| 2067. | CAAGCATAATGTCACGTTCATATC[A,G]TGAGATATTAATCACTGTCCTTTGT | 780,627 | 100 |
| 2068. | TCAACAATCACTACATCCAAAGGC[C,A]GGTGCCTTATTTTtCTTCAAGATGC | 780,688 | 100 |
| 2069. | GAGGAAGGTGAGCAGAGCATTCCA[G,A]TTTCTCAAAGGGCAGTTAATATGAT | 780,759 | 100 |
| 2070. | TAACAAGAGTAACACATTACAGCC[G,T]AATGCAGGGCTCATTTAATATCCAT | 780,830 | 100 |
| 2071. | CAGACTTGACATAAGTGCTCTGGC[A,G]CAATAAGGACTCTCATAAATCAGAT | 780,999 | 100 |
| 2072. | ATATTCTCAGTATTGTGGGTGAGG[G,A]AGAGTAAAGGGTCAGACTTGACATA | 781,036 | 100 |
| 2073. | AATTAGTGTTATTTTAAAGCATCC[C,T]TTTTTTGAAGCACAGCTGGTGAGAA | 781,100 | 100 |
| 2074. | TGCTTACAATAAAGTCACTTTAAT[C,A]TGAAGCCATATCTTAGATAAATTAG | 781,144 | 100 |
| 2075. | TGAGTTCAGAAATCAGCATTTGAC[C,T]GTGCATGTAATTAATGGTTTGTGGA | 781,937 | 100 |
| 2076. | CTTTTCTACATTATCTTAGATTAG[A,G]TGGATATGGAAGTGAGTTCAGAAAT | 781,974 | 100 |
| 2077. | CTTGGTTATGTTTTATCCTAAGCA[T,C]ATAGGAACAAAAGTAAGCCAAGGAA | 782,198 | 100 |
| 2078. | GTTTCAGGAGTGTCAGGAAGGAGG[A,T]ACTACAGAGCAAAAATAAAGAAAGG | 782,408 | 100 |
| 2079. | GTCTGAAATAGGAACAAAACTAAC[C,T]TAGTTCTCACCTAAGCATATAATTT | 782,505 | 100 |
| 2080. | TAAAAAGAATAGAGAAAAAGCTTG[A,G]AGTAACGAAAGCAATTAACAAAAGT | 782,624 | 100 |
| 2081. | CAAAAATCCACAAAATGCTTTATT[A,T]GTCTCCCTGTACAACAAAATAAAAA | 782,668 | 100 |
| 2082. | AAGGGACTTGGCCCAATTAAATCA[C,A]TTTATGGAGTCCCTTCATCAGGATA | 782,854 | 100 |
| 2083. | ACAGACCGTGCAGGATCAAGAAAG[C,A]AGAAAAGGAGAAAAGGGACTTGGCC | 782,891 | 100 |
| 2084. | GGAACAAGGAAACCTAATCAGACA[G,A]ACCGTGCAGGATCAAGAAAGCAGAA | 782,912 | 100 |
| 2085. | AGAATCTCACAAAGAGAATACCTG[T,C]GATGCAGCTAGCCACTGGATCATAC | 783,375 | 100 |
| 2086. | TCCAACAGTTATGGAAGACATATT[C,T]GAACAAAGGAATGAGTTGAATCACC | 784,113 | 100 |
| 2087. | AAGTCACCCACTGTCCATCCATGC[A,G]CCAAGGTCCATTGAGTCACCTGATT | 784,265 | 100 |
| 2088. | AGAATGACACTACTCAGACATATC[T,C]TGCACGTCATTTGATGTGCTGTGAT | 784,395 | 100 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 2089. | GAAGAATGACACTACTCAGACATA[C,T]ATTGCACGTCATTTGATGTGCTGTG | 784,397 | 100 |
| 2090. | aAGAaAAAGAGCTAAATGAGTCAC[G,A]CCTTAGAAGAAATATAAATATTAAA | 784,494 | 100 |
| 2091. | TCCATGCCAGCAGGAAAACAAAAG[C,A]ACGCATCTTATGACTGCCCCAACAA | 784,776 | 100 |
| 2092. | GATGAGCACCATATTTCCATGCCA[G,A]CAGGAAAACAAAAGCACGCATCTTA | 784,791 | 100 |
| 2093. | TGGACAATTCAGCACTTGCAATCC[T,C]ATTAGCAAGCAAGATTTCTTCTCGT | 784,955 | 100 |
| 2094. | GCACTTGCTGCCCGATTTTCTACC[G,A]ACCAAATGGCATCACTTCTGGCTGT | 785,123 | 100 |
| 2095. | GAATTGACAAACCAAAAAGTTGA[G,T]GGAGCCTTCCAACATCACAAAATGC | 785,320 | 100 |
| 2096. | TTATCTGGAGCACATCACTTCCAC[A,G]TGGAGATAGTAGGTCTTAACAGAAT | 785,385 | 100 |
| 2097. | GCCGAACGTAGACGGACTTGACCC[A,G]CTCCTGACCTAACTTGGACCTTGGC | 787,420 | 100 |
| 2098. | ATACCGCGACAATGATTGGATAAG[G,C]ATGCCAAGTGGGCCGAACGTAGACG | 787,456 | 100 |
| 2099. | TCTGTTCTTCCTCGTCGGAGTCAG[G,T]GTCTTCTTCATCTTTCCCATCGCCG | 788,028 | 100 |
| 2100. | AATGATTTCAATGAGATACATTTG[T,G]TGATACCACAATGTAGGAATGTGGA | 788,520 | 100 |
| 2101. | ACACCCCAATTGGAAGGAGAAGGT[A,C]TTGATCTTCTGCACCATTTCGAGAG | 793,935 | 100 |
| 2102. | AGGTCCATTAATTTTCCATGACAT[G,T]ATTtTTTTTTCCCGAAAAATGATAT | 794,054 | 100 |
| 2103. | ATTTTCCATGACATGATTtTTTTT[T,C]CCCGAAAAATGATATCCTAGTTATT | 794,064 | 100 |
| 2104. | CGAGTCATTTCATAGTTTCTGGAT[G,T]ATCTAACTGTTGTTATTCTCGAATT | 794,299 | 100 |
| 2105. | GAGTCATTTCATAGTTTCTGGATG[A,T]TCTAACTGTTGTTATTCTCGAATTA | 794,300 | 100 |
| 2106. | TCATAGTTTCTGGATGATCTAACT[G,T]TTGTTATTCTCGAATTAGGTTAAAC | 794,308 | 100 |
| 2107. | TCATTTTAACAGCTAACCAACTTT[T,C]AAATTACAAACTTATTCTTTCAAAC | 794,499 | 100 |
| 2108. | ATATATGACTTTCTCAGCAGACCC[T,G]CACCATAATTTTCATGCTGCTTCTT | 794,623 | 100 |
| 2109. | ACTCCAAAATTCGTTCTCCTTGGC[A,G]GGGTAGTTTGTTGCCATTACGTGTA | 795,254 | 100 |
| 2110. | AGTTGTTTTTCAGCTTATATCAAT[G,T]AGCAATTTTCCTCCAACATATTAAG | 795,317 | 100 |
| 2111. | TTAATGTATTTACTTACAGTAAGC[T,A]CGTCACAAAAAACCAGGgTTTCATA | 795,430 | 100 |
| 2112. | GTAAGCtCGTCACAAAAAACCAGG[G,T]TTTCATATATGTAGAGAAAAGTGTA | 795,448 | 100 |
| 2113. | CAGGgTTTCATATATGTAGAGAAA[A,T]GTGTACATACAATTCATGGGCATGC | 795,468 | 100 |
| 2114. | TGCATACAAAGTAATTGAATACAT[A,T]TGTGGACAGTATACTGGAGGAAACA | 795,515 | 100 |
| 2115. | TTCTCAATCCTCAATGGCAATTGC[C,T]GCAGATGAGGGGTAATTACCTGTAT | 795,785 | 100 |
| 2116. | GAAATAGGCAACTCAATAGATGTT[C,T]TTGCAAGCATGTTGTAAACATCGCA | 795,945 | 100 |
| 2117. | ATTTATTGAAAACTGCGACCTTTG[C,T]GAGATATATGGGAAAAAaTAAGGAG | 796,033 | 100 |
| 2118. | TTTATTGAAAACTGCGACCCTTTGc[G,A]AGATATATGGGAAAAAaTAAGGAGG | 796,034 | 100 |
| 2119. | AAGCTGGCGCGCAATAGAAATTGC[A,G]GCTCAAATCGGCAGTTGATTGTAGA | 796,169 | 100 |
| 2120. | TGTGTGCCAATCATGGGCAAGAGC[T,C]AAGTTGATGCAtCCTAAGATAATGG | 796,494 | 100 |
| 2121. | ATGGGCAAGAGCTAAGTTGATGCA[T,C]CCTAAGATAATGGCTGAGTCAAGAT | 796,506 | 100 |
| 2122. | TGATAAAAAaGTAGAAAGGTCAT[A,G]TTGCAGGTTGGATCAGAAGGTGAGA | 796,723 | 100 |
| 2123. | TTGCATCACAAAAATGATTTTGTA[T,C]TTCAATTATATGGAGGTTATGGATG | 796,990 | 100 |
| 2124. | TAATCCATATTCAGGACAGTGAAA[T,G]AACAAAAAaGGGAGGGCCTTTATGG | 797,189 | 100 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 2125. | TTAATCTGTTCAAATATTTTTTtC[A,C]aTGAAATTTTGTTACTTTTAACTCT | 797,587 | 100 |
| 2126. | TTTTtCAaTGAAATTTTGTTACTT[T,C]TAACTCTTTTCTTATTATGTGCTAT | 797,605 | 100 |
| 2127. | TACTTCTGTGAAATTTGACAGGAG[A,G]TTGCGGAAACTGCATTCAGGAATAT | 797,654 | 100 |
| 2128. | AGGGAAGATTATGGAGCATTTAAT[G,A]TGTAGAAGCCTAATTCGAGCTTTAC | 798,126 | 100 |
| 2129. | TGTATGACAAAAATGTCAATGGCC[A,T]CTAAAAGAATAAGCAACAAGCTCTT | 798,383 | 100 |
| 2130. | AATATCTGTATGATAGCTTTTCCA[C,T]GCAACTGTACAGGTCTATCAGTATA | 799,055 | 100 |
| 2131. | TCTTCAATGATTGCTACTATTACA[C,G]TTAGTTTGGTGTCATTATAGAACTG | 799,125 | 100 |
| 2132. | AGTTTTTGAACACATGCAACTTAA[C,T]GATGACCAGGTACGAACAGCTTATA | 799,572 | 100 |
| 2133. | ATATTCATtTTTTTTCTTAAaAAA[G,A]AATACATTGCTTGCTGTTGATGGCA | 799,829 | 100 |
| 2134. | CACTTTCACAGGTTTGATGCCATA[T,C]tGTCCAAGACATTTAGAGATTGTTT | 799,892 | 100 |
| 2135. | GTCCAAGACATTTAGAGATTGTTT[G,A]GATGTCTGGGCCCAAAATCCCATGA | 799,918 | 100 |
| 2136. | TAGGCTTGTATTCACAAATATCTC[C,T]CTATGAGATTCGGGCTGGCCCACTC | 800,013 | 100 |
| 2137. | TATTATTTATCCCCAATCCTAAGG[C,T]GGCATTGTTTCTTCTCAGATTCCTT | 800,377 | 100 |
| 2138. | TGATGCAAATTCTGCCCACACTGA[C,T]GTGCGGTCGTTTGTTTCTAATGGGG | 800,769 | 100 |
| 2139. | GGGATTATGTACATTCTGATGCAG[T,C]aCAAGGACTTTAATGTTGTCATATc | 800,814 | 100 |
| 2140. | GTATCATTCCAACCATATCATCTT[T,C]GTCTGCAAGAAAAAGGATTATGTAC | 800,839 | 100 |
| 2141. | GTATCATTCCAACCATATCATCTT[T,C]CGTATcAAAAAAAaTCTCTACTTCT | 804,008 | 100 |
| 2142. | AGTCCAAATCTTATATGTCGTCAA[A,G]AAATCTTTTGTAATAATATGTTGTT | 804,103 | 100 |
| 2143. | TTGTAATAATATGTTGTTTCACTA[T,C]ATGTCGGTCTTCAAGAAAACGATTT | 804,135 | 100 |
| 2144. | TGTCTGATTAACATATGCAAAGTC[T,C]AAAAATTTATTGACCCCCTCAATGT | 804,223 | 100 |
| 2145. | CCCTCAATGTATGTAGGTGAAGTC[T,C]TTTCTCGCAAATCAATCCAACTTTT | 804,263 | 100 |
| 2146. | ACTTTTATCCATAGTAGAGGCCAA[C,T]GTGAAGAAGGGTCCCTTGGTCTCCTG | 804,307 | 100 |
| 2147. | TCCTGAGGAGGACTCCAAGCTTAA[G,A]GAGTTCATAGAGAAATATGGGACTG | 804,352 | 100 |
| 2148. | ACTGGTGGCAATTGGATTGCCCTC[T,C]CTCACAAGGTTGGTAAGAGAGTGAT | 804,398 | 100 |
| 2149. | ATTGGATTGCCCTCTCTCACAAGG[T,C]TGGTAAGAGAGTGATTGAGATCCTT | 804,408 | 100 |
| 2150. | CTTCTCTACCTGTTTAAGAGGGAA[C,T]AGACATGATCTTCTTTTAATAGGAG | 804,483 | 100 |
| 2151. | CTACCTGTTTAAGAGGGAACAGAC[A,G]TGATCTTCTTTTAATAGGAGAGAGA | 804,488 | 100 |
| 2152. | ACAGACATGATCTTCTTTTAATAG[G,C]AGAGAGAGATTTGGTGTCATTATGT | 804,506 | 100 |
| 2153. | CCTGAGGCCTAACATAAAGCATGG[A,G]GAGTTCTCAGATGACGAGGACAGGA | 804,638 | 100 |
| 2154. | AAAGCATGGAGAGTTCTCAGATGA[C,T]GAGGACAGGATAATATGCAGCCTCT | 804,653 | 100 |
| 2155. | TATGCAGCCTCTTTGCTAGTATCG[G,A]AAGCAGGTGAGAGACAGCCTCTTAA | 804,691 | 100 |
| 2156. | ACAGCCTCTTAATACAATCCAGTT[C,T]TTTCCAAACTCTGTCTCCCTCATCG | 804,729 | 100 |
| 2157. | GATAACAAAAATCAATTAGATAT[A,G]TCTTTTTTtGAGGCTGTAAAACAGC | 804,908 | 100 |
| 2158. | AAGGGTTAAACAGAGATCAAGACT[G,A]GAAGATGGAACAAACTATATATTCC | 805,045 | 100 |
| 2159. | TCATTTGTTCTCTCTATTCGGTTG[A,G]CATCGAAGAGGGAGAGATCGAGAAG | 805,095 | 100 |
| 2160. | ATAAATTATTTACCACGATCCACT[A,G]TCGTGGTAAAAATCGTAGATTATTT | 805,585 | 100 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 2161. | GATGATAATTAAGGGATTCGCTAA[C,A]CTTTCTTAATCCACTTGATTGAaAA | 805,826 | 100 |
| 2162. | AAATAGTGCTACCATAATGGCATG[C,A]CTTTCTTAATCCACTTGATTGAaAA | 806,191 | 100 |
| 2163. | GGAAGGTGTCAACAAAACAAGTGC[T,A]TGCATCTAGTCATTTTACACATACC | 806,685 | 100 |
| 2164. | ATTTTACACATACCAAATTAGGAT[T,G]AACAAATTAATTTATTAGTTGGCGT | 806,821 | 100 |
| 2165. | TTACACATACCAAATTAGGATTAA[C,A]AAATTAATTTATTAGTTGGCGTACT | 806,724 | 100 |
| 2166. | TAAATCGATCTGGAACAAAAATTT[T,C]GAAATATATATTCAGACTAAGGAAA | 806,787 | 100 |
| 2167. | ATAAAATTTCTTTATCACTTTACA[A,G]ATAACTGCAATGCCAATTACCAATA | 807,000 | 100 |
| 2168. | AGTATTTTTATATCATCCTCACA[A,G]GCATATTCCCACCATATATGAGATA | 807,142 | 100 |
| 2169. | CCTCACATGCATATTCCCACCATA[T,A]ATGAGATATAAATACATTTACAAAA | 807,159 | 100 |
| 2170. | GCAGAGGTTCGACTCTGAGAGCAA[C,T]TTCCATGCCAACGGCCACAAGTTGC | 807,461 | 100 |
| 2171. | AAGCTTGAAGGCTTCCATGAAGAC[C,G]ACAAGAGACATAGGCGGTATCGGTC | 807,531 | 100 |
| 2172. | TGTAGATAGAaCTGGTTTTTAGAT[T,A]tAGTTTGTGATGCAAGTCTTTATGT | 807,750 | 100 |
| 2173. | ATTAAGTGTTCCTTAATTTATCCT[T,C]taTTGAAAGAGAAGGTGGCTGCCCa | 807,817 | 100 |
| 2174. | taTTGAAAGAGAAGGTGGCTGCCC[A,T]GCCAGTCTCTGTGTCTGAATTGTAG | 807,842 | 100 |
| 2175. | GGAGCTGCACAAGTAATTTTCACA[G,T]AGTGCTATGTGCACATATTTGTTCA | 808,073 | 100 |
| 2176. | TCTCTGATTTATTGACCATAACCA[T,C]TAAATCGGTAGTTCAGGGTATTGTG | 808,133 | 100 |
| 2177. | AAGGTGGATAATTGGAAATATATC[C,T]GAGCTTTGCTTAATTTTCTTCTCAT | 808,494 | 100 |
| 2178. | CTTAATAAAGCATCTCATTGAAAA[G,A]CATATTTCTTAGTATATAATCTATC | 820,377 | 100 |
| 2179. | GGCAGATCTTGGATATTTATACAA[G,A]ACTAATCAATCCAAATAATATCTTC | 820,483 | 100 |
| 2180. | TGAGAATCTCAGAGCTTAAATGGG[G,A]GAGTATGTGAGGACTGTGCAGGTAT | 820,701 | 100 |
| 2181. | TCCAACAAGAAGTTCTATCTTATA[T,C]GATTGAAAATTGGAGAAACTAAATA | 820,997 | 100 |
| 2182. | AAGAAGTTCTATCTTATATGATTG[A,G]AAATTGGAGAAACTAAATAGCATGA | 821,003 | 100 |
| 2183. | ATTCCCTAAAATCTACCCCCAACC[A,G]TCATAACTATTTTAACATATTCTAA | 821,092 | 100 |
| 2184. | ATTCAATGGTATAATTACTATGTC[G,A]AATTATATTATGTTAAATAGAAAAC | 821,238 | 100 |
| 2185. | TTAATATCTAGTACATTATGCATT[T,C]GATTTTATTGGATAGACTAACTACC | 821,302 | 100 |
| 2186. | TTAAATAGGCTGGCCCAAATATGA[C,T]TAAACAATGAATATAGTTTAGGCCC | 825,196 | 100 |
| 2187. | GTCGGCATGCAACTTTGAGTGGAA[A,T]GAGATTTTCACCATATAATCACCAT | 825,409 | 100 |
| 2188. | AGAGATTTTCACCATATAATCACC[A,T]TATTACTGCAACTAATTTTTAGCAC | 825,433 | 100 |
| 2189. | TAATCACCATATTACTGCAACTAA[T,C]TTTTAGCACATGCCACCTTTAATTC | 825,449 | 100 |
| 2190. | AATTATTTTATTTGCAACAAACCT[T,C]ATCGCAGCTTGATTTTCTCAATTTT | 825,563 | 100 |
| 2191. | ATCAAAAACACGGGCAGCATGCTC[A,C]CGGTCGGCACTAATAAAGCAGCAGC | 827,934 | 100 |
| 2192. | AACACGGGCAGCATGCTCACGGTC[G,A]GCACTAATAAAGCAGCAGCAAAGGA | 827,940 | 100 |
| 2193. | TTTTTCTCAGCTTTGTTCGCTTTT[T,A]GGAACCCTATTCGCATCAAAAATTC | 828,487 | 100 |
| 2194. | ATTAATTGTGCACATGTACAAGGA[T,C]GGTGTAATTGCGCACAAGAGTGTGT | 829,836 | 100 |
| 2195. | GCATAGTCTTTCGCACTTTTTTTt[A,T]AAAAAAaTAAATAAATAAACATAGG | 831,203 | 92 |
| 2196. | TTAGCTTCCCGATACGGTACCGAT[A,G]GTTGTTTGTTATTCCACGAAATCTA | 831,536 | 92 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 2197. | ACGGTACCGATAGTTGTTTGTTAT[T,C]CCACGAAATCTACTCGAATGGTTAC | 831,549 | 92 |
| 2198. | ATCAACCAGGAACTTGCTTGCTTC[G,A]TGATATCATTGCCAAAATTTTGTGA | 833,028 | 92 |
| 2199. | CGCCAACCAGCCCTTTTGGTTGAG[G,C]ATAATCTGACATAAAAAATATATCA | 833,084 | 92 |
| 2200. | ATATTTATCAATAAATATTAATTA[T,C]TAATAAATAATTAATAAATAGAGGT | 833,377 | 92 |
| 2201. | TTAATAAATAATTAATAAATAGAG[G,A]TTAGTTAAAATAAATCTAACATAGG | 833,401 | 92 |
| 2202. | ATTAATTTAAGATATTTATTAATT[T,C]ATTTAAATATATTTTAATATTTGAA | 833,529 | 92 |
| 2203. | AATTTAAGATATTTATTAATTTAT[T,C]TAAATATATTTTAATATTTGAAATA | 833,532 | 92 |
| 2204. | TTTCTGATGCTATTTTATGGAGTG[A,C]TTTTTCTATCAACCATACACAATAA | 833,739 | 92 |
| 2205. | AACATTGCAAGTACCTCCCACTCC[A,C]ATACCTAAATCTATTTAGCCAATTC | 835,834 | 92 |
| 2206. | CAAATATTTATGTAAAATATATCC[A,C]CTCAAAAAGCATAAGAAACAATTTT | 835,888 | 92 |
| 2207. | ATGAATGGACTTGGAGGAAGAAAA[A,G]GATGAGAAGaAAAAATGAATAAGGA | 836,505 | 92 |
| 2208. | GAGAATGATCATGGATAAGGAATA[G,T]GTTAGAGAAGAAGAAGAAGGATAAG | 836,567 | 92 |
| 2209. | GGCTTGAAGAAAAAAAaTGAGGAG[A,G]TAAAGTGCATGGGAAGAAAGGAGAG | 837,072 | 92 |
| 2210. | TTAAAGTAGTAAAAATTGTCAGCT[G,A]GCCAATCATAGTTAACAATTAAACT | 840,743 | 92 |
| 2211. | CACTAGGCTCCTAATTACTAAGTG[G,A]TCATATGTATTTAATCTTATTTTtA | 841,235 | 92 |
| 2212. | CCACATACAGTCGCTAATAATCTC[A,G]CCGTCGCTAATTCCGTCGTAACAGT | 841,920 | 92 |
| 2213. | AGTTTACCACATGACATGTGTACC[G,A]TAGAACTATGTGAGCTGGCTACATA | 842,938 | 92 |
| 2214. | TCTCTTCAATATCTATTTAGTTTG[G,A]ATCATTATCAAAAAAAaTTAAGAAG | 844,223 | 92 |
| 2215. | CATCGACATCCGTCAGTTTTAAGA[C,T]ATCATATGAGAAGAAGTAAAAGAGG | 844,302 | 92 |
| 2216. | AAATTAGATTTGACTTAATTTGAT[G,A]TTAATTAGATTTTATAATTCAAGTA | 846,036 | 92 |
| 2217. | TTGAGTTTTATAATTCAAGTAGGG[C,T]TTAGATTCGAAGTCTAATTGAATTA | 846,731 | 92 |
| 2218. | CAAAGTTATGAACTGAACAAAGAA[T,A]TAAATATTATATGCAGAGAGATGAA | 847,973 | 92 |
| 2219. | TTAGGTCATTAAGAATATATATTA[G,T]GATGTTTTCCTTTCACCTGATATCA | 849,575 | 92 |
| 2220. | ATGTTTTCCTTTCACCTGATATCA[A,T]TTTTTGGAATGATCAAATTGTCTGA | 849,601 | 92 |
| 2221. | GATCAAATTGTCTGATTTGATTAT[C,G]CTAGACAAGGCAATAGCATATTTAT | 849,636 | 92 |
| 2222. | ATATAAAATATCTAAAATAATATC[A,G]TATTATTTTATTTTCTGGTAATATT | 849,799 | 92 |
| 2223. | ATTAGTTTAAAATATATTAAAGTC[G,A]TAACAATTATTGGTGTGGCGCTATT | 849,849 | 92 |
| 2224. | ATATAAAATACATTATTATTGAAA[T,G]ATTGATAAAAATATGGTATTATATA | 849,924 | 92 |
| 2225. | GTATAATAGTAAAAAATATATTTT[C,T]CTTATATATACATATAGTAAAAGCT | 849,989 | 92 |
| 2226. | TTTTTATTATTACTCAACCATATA[T,A]ACCACTAACAAGAAAAATGATATCC | 850,041 | 92 |
| 2227. | TGAGCCAAATAAACATAATAATGG[G,C]TTAGAAAGGGCATCTATATCCATTT | 850,170 | 92 |
| 2228. | ACCTTTGTTGGTCTTGAGTTGTCT[A,G]TCCTTAGCTCATCCTTGGTTGGATA | 850,309 | 92 |
| 2229. | TGCTATTGTCTATCAATATTTTTG[T,C]CCAGCTATCTTAGCCACATCATTGC | 850,599 | 92 |
| 2230. | CAAACAAAAATTGGACAGACAAAC[A,G]GTCCAAATTGAGTTTCAAAAAAaTG | 850-776 | 92 |
| 2231. | GCCCAATTTGCCCACTTGCTAGCG[A,G]GGGGGGCAATTTCTGACATGGCAAT | 851-412 | 92 |
| 2232. | ATGTATACATTCGAAATGGTTGTG[G,T]GTTTAGAACTTGCCATGCATAATTC | 851,571 | 92 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 2233. | GTGGGTTTAGAACTTGCCATGCAT[A,T]ATTCATGGTCAAGCCAAAATGGGGG | 851,592 | 92 |
| 2234. | AAAATGGGGGAAATAAAGGAAAAA[A,G]TTAAGGAAAAGGCGAAGTGAGTGGC | 851,632 | 92 |
| 2235. | GGGAAATAAAGGAAAAAaTTAAGG[A,G]AAAGGCGAAGTGAGTGGCTTGTTCA | 851,636 | 92 |
| 2236. | AGGAAAAGGCGAAGTGAGTGGCTT[G,T]TTCAGAATCTGTCATGTTTTCTTCT | 851,660 | 92 |
| 2237. | GCGAAGTGAGTGGCTTGTTCAGAA[T,C]CTGTCATGTTTTCTTCTATACTTCA | 851,668 | 92 |
| 2238. | CTTTCAGTTTCCCCGGACAACTAT[A,T]CCTTCAATCCCCTTTTCCTGGCCCT | 851,744 | 92 |
| 2239. | CCATATAAAATAAACGAGCTGGGT[A,G]TGGTATCATTCTTTGCAACTCAATT | 851,844 | 92 |
| 2240. | CAACTCAATTATAAATAGCTTAGG[T,A]ATGAATTAAAGTTTTTGTTTGACTA | 851,884 | 92 |
| 2241. | TCGGAATGAAGCCCAAGGACCTCA[T,A]ATTTATGTCTAGATTTCCACCCAAC | 852,015 | 92 |
| 2242. | CAACCGTGAAACTAGGCCACGCTA[G,A]TTTGGGGCCTGGGGAATCTGAAATT | 852,061 | 92 |
| 2243. | TAGTGGCATGACATTGTAGCTAAC[A,T]CTTTTCTCAAAAACGGGAAAATAAG | 852,222 | 92 |
| 2244. | GGCATGACATTGTAGCTAACACTT[T,C]TCTCAAAAACGGGAAAATAAGAAAA | 852,226 | 92 |
| 2245. | AATAAGAATTACGACCAATGTTTT[G,T]GATAGGAAATGGAGATCGATGGTGA | 852,363 | 92 |
| 2246. | TTAGACATATCTTTAAAAATTAAT[T,C]TGAAATAAATGCTAACTTAAAATTT | 854,149 | 92 |
| 2247. | TCCTTTTACTTATGGAGTTTCCTA[A,G]AAGTGTAGCAATATTAGACTTATTt | 854,347 | 92 |
| 2248. | CTTTTACTTATGGAGTTTCCTAAA[A,G]TGTGTAGCAATATTAGACTTATTtTT | 854,349 | 92 |
| 2249. | TAAATCAGTAAAAAAGTTATTATT[G,T]AATAAATTAAAAaTTAAAAAaTAAT | 854,421 | 92 |
| 2250. | ATCAGTAAAAAAGTTATTATTGAA[T,G]AAATTAAAAaTTAAAAAaTAATAAT | 854,424 | 92 |
| 2251. | TTTTttTTTTGGTACAAACGAACG[G,A]TCATACCAATCTAGTGTAAGAACAT | 854,504 | 92 |
| 2252. | GGTCATACCAATCTAGTGTAAGAA[C,T]ATTTCAAAGAGTCAAAATACAAAAT | 854,527 | 92 |
| 2253. | CTTCATCTCATCCTAAATTCAGTC[A,G]ATGACTGGAGTGGAGTCACCCTCAA | 854,762 | 92 |
| 2254. | GGAGTCACCCTCAATGAAGATCTT[T,C]TCAGCCCACAACTCCTGTCTCGTAT | 854,798 | 92 |
| 2255. | GACAGATTCGGAGGAAGGTGGCTC[T,C]CAGGAAATGAAAGAACCCTTCGAGT | 855,009 | 92 |
| 2256. | GTGCAGCAAGAGAATCCTAAAAAC[T,A]TGAGGCAGCAAGGCTCGGACCAGCA | 855,067 | 92 |
| 2257. | TAAAAACTTGAGGCAGCAAGGCTC[G,A]GACCAGCAGTGTCGAAGTGACAGCA | 855,084 | 92 |
| 2258. | GGCTCTTTACAGTACCCATTGAAT[C,T]GATATAATCTCAGTATCAAACAAAA | 855,152 | 92 |
| 2259. | CTCTTTACAGTACCCATTGAATCG[A,G]TATAATCTCAGTATCAAACAAAAGG | 855,154 | 92 |
| 2260. | AAGGCTATTGTTGGACAGCCAAAC[C,T]TGATAAGTGACATACACCATCCTAC | 855,200 | 92 |
| 2261. | CCCTTGCCATGCTCCGATGGATCA[T,C]GTCTAAGAAGGGAGGAAGCTAAGGG | 855,264 | 92 |
| 2262. | TCCAGCCCGCAAACTAGGTAGATA[A,G]TTAGAACCTCCATACCTCTATCTTT | 855,406 | 92 |
| 2263. | CTTCTAGAGAAAAAGCCTAAACCT[G,A]GGATGGGCAACCATTCTCTAAATCC | 855,492 | 92 |
| 2264. | GAGCCCTCCAACTCCTGTCGTCAA[T,C]AGTGATCGAATTATAAACCCACAGA | 855,719 | 92 |
| 2265. | GAGAGAGAGGCAAACTAGAGATCC[C,A]AGCATCCTGGCTCACATCAATCGAG | 855,806 | 92 |
| 2266. | GCATCCTGGCTCACATCAATCGAG[A,G]TTCTGTCTCCAATCAGCTACTTGAT | 855,832 | 92 |
| 2267. | AGCTGTATGTCTGAAAATCATAGC[C,T]TCTCTCCTGACTAGCAAGGATTGGA | 856,036 | 92 |
| 2268. | AGCAAGGATTGGATTCTAAGACCC[T,C]CATCCCGCACCGGCTGACAGACCAC | 856,073 | 92 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 2269. | GAAGAGAGCGTTGGCTTGCCAGCC[A,G]TCGAAGCGATCTCAGACTTGCTGCT | 856,293 | 92 |
| 2270. | ACCTTGCATTTCGAACTGAAATCT[G,A]ACTAATGAGCAAGCAGTCATCTGTA | 856,556 | 92 |
| 2271. | TGCATTTCGAACTGAAATCTGACT[A,G]ATGAGCAAGCAGTCATCTGTAAAAG | 856,560 | 92 |
| 2272. | ACCAGAGGGCCTCTCGTACCTCCT[C,T]AGTAGACACAGGGCGAGTTAGAATC | 858,614 | 92 |
| 2273. | TCCAACGTGATTTAAAGAAATACA[T,G]AATCTATCTCCTAATCTCATAATAC | 858,737 | 92 |
| 2274. | AGTAGCTTATGTCAAAGCTCCCTT[G,A]GGTCAAGCTCTTGAAGGCCCCCTCC | 858,947 | 92 |
| 2275. | TTGAAGATATCACCAACCTTCAGT[C,T]GGTTCCATCAGATATGCCTGCGCCG | 859,051 | 92 |
| 2276. | ATCACCAACCTTCAGTCGGTTCCA[T,C]CAGATATGCCTGCGCCGCGCAAACT | 859,059 | 92 |
| 2277. | CGGATCAACATCCTTCAAACATCC[C,T]TAATCAGATCTAGGATTTCGGATAG | 859,139 | 92 |
| 2278. | CATCCTTCAAACATCCCTAATCAG[A,G]TCTAGGATTTCGGATAGAAGGTCCA | 859,147 | 92 |
| 2279. | CAGTGGTGATGAGAAGTGGGCAAC[G,A]GTTCGAAGCAATACTCGGAAGGTGC | 859,264 | 92 |
| 2280. | ACGCTCGATCAATCCTCTCCCAAA[T,C]TCTAGCTGTCCCAAGCCAGTTGTTG | 859,349 | 92 |
| 2281. | CGCTCGATCAATCCTCTCCCAAAT[T,C]CTAGCTGTCCCAAGCCAGTTGTTGC | 859,350 | 92 |
| 2282. | ATACTATCCACATACTGCTTGCCA[C,T]CCATCTTCTCATGGGACTCCACTAT | 859,482 | 92 |
| 2283. | GCCACCCATCTTCTCATGGGACTC[C,T]ACTATATAGTTGAAATCCCTAGCGA | 859,502 | 92 |
| 2284. | CTATAGCACCCTCCGCTCCCTGTA[C,T]TTGGTGCTCGCATATCCTCCGGACA | 859,595 | 92 |
| 2285. | CCGGACAGAAGCCAAAGACCATCA[G,A]TTTGCTCAGATATGACTAACGCCAC | 859,638 | 92 |
| 2286. | ACTCGACGTCTCCCTGAAGCCCTG[A,G]CCCAGTCCTCTCGAGAGCCATCTCC | 860,511 | 92 |
| 2287. | AGTTTGTATATGAGTTAAATTCTG[C,T]TATACTTTCATCATGTTCTGATTTT | 861,047 | 92 |
| 2288. | CACAGTCTTGAAAATCATGTATTT[T,C]ACACCAAGCCTTTGTTCCATATTGG | 861,193 | 92 |
| 2289. | TTTATGGTTCCCTCCTGGGTTCTT[G,T]GGCTTGCATGTGATTTGGGCTACTT | 861,551 | 92 |
| 2290. | TGGTTCCCTCCTCCCTTCTTGGGC[T,A]TGCATGTGATTTGGGCTACTTGGAC | 861,555 | 92 |
| 2291. | CATGGTTTCTCTGGACAATTTATA[T,A]CGAATACCAAGGCAAATGTATCCTT | 861,640 | 92 |
| 2292. | TCCTTCTAATGTCTCAAATTTCAG[C,T]AAAAGTGTTAGGATTGACATTACCT | 861,685 | 92 |
| 2293. | TCTATCTCACACTTAATTTAAATG[G,T]CATGCACAATTCAGGCTTTTGTATA | 861,756 | 92 |
| 2294. | TAATTTGTTCCATCAGCCCCTTTT[T,G]ATGTGCTTATTTTTTtAAGCACCTC | 861,825 | 92 |
| 2295. | ACTGGACTCCCATTGGTAAGCAAG[A,G]AAAAaGAAAGAATTAGACTACATG | 861,935 | 92 |
| 2296. | AAAaGAAAGAATTAGACTACATGC[G,A]TTGTTTTCCTTTTGTCAACTTGTGG | 861,962 | 92 |
| 2297. | AACATGTAAGCTTGGTAGAGTCAT[T,G]AATTTTTCTCCTGGATAATCTGATC | 862,095 | 92 |
| 2298. | TAAGCCAGCGACTCTTTCCGGTCT[G,A]CAAGCACGATTGGTTGGGTTAAGCC | 862,155 | 92 |
| 2299. | GCGACTCTTTCCGGTCTGCAAGCA[C,T]GATTGGTTGGGTTAAGCCACTTTTC | 862,162 | 92 |
| 2300. | TTAGGTCACTTCAATCTTTATAAG[G,T]TTTCAAAAATTGAATCCTAGAACTC | 862,478 | 92 |
| 2301. | CTCGTAGAAACAAAAATGAGCAAT[T,C]ACCTTTTCCGGTTTCTTTGTATCTG | 862,679 | 92 |
| 2302. | ACGGGGGTGAGCAATTACCTTTTC[C,G]GGTTTCTTTGTATCTGCAAGTAACA | 862,688 | 92 |
| 2303. | TTCTTTGTATCTGCAAGTAACATT[C,T]TCTCAACATTCAACAAATATATGAT | 862,716 | 92 |
| 2304. | GTTTTACTTGGATTTGTTTCTTTT[A,C]CTTTCTTTCTCTATCAATATGGTGC | 862,866 | 92 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 2305. | TGGCTGCACTGAATTTTTAGGCAT[G,A]ATGATAAACCAAAATTTTCAAGCCT | 863,053 | 92 |
| 2306. | TTAAATTAGACTTATTGAAAAAGA[T,A]AATATGCATATTTCTATAATACATC | 863,255 | 92 |
| 2307. | GGTCCAGCCAATTTACTTAATCAT[G,C]CTTGGCTTGTGCGGAACTTGTCCTA | 863,334 | 92 |
| 2308. | ATCTCTCAGTAGAAGAGAGTAAAA[T,G]GCTTGCTCATGAGAATGCGAAAGAC | 863,626 | 92 |
| 2309. | GTTGAGTGTTGTCCTTTCACTTGC[A,T]TGAATAGATATGCCAATATCTAGTG | 863,751 | 92 |
| 2310. | GTCCTTTCACTTGCATGAATAGAT[A,G]TGCCAATATCTAGTGGCATAACAAG | 863,761 | 92 |
| 2311. | TATGCCAATATCTAGTGGCATAAC[A,G]AGAACAATGTTGTTATTGAGGTCAT | 863,784 | 92 |
| 2312. | CTGTTTCATGTTTTTtCTTAGTTT[A,C]TTAGATTTCACTCTGGAGCATTAAT | 863,867 | 92 |
| 2313. | CACTTAAATTCCATTTGCATAGTG[G,A]ATGTTGTTTAGTTATTCCTACCATT | 863,995 | 92 |
| 2314. | ACTTTCATGTGACACTGAATTTAA[C,T]TCTCATTCAATGGATTAATCTCCTG | 864,370 | 92 |
| 2315. | GTTGCAAAGTGCATCACGTTTAAT[A,T]AGGTAAATGCTAGAGTCATTTGAGA | 864,467 | 92 |
| 2316. | GCATCACGTTTAATAAGGTAAATG[C,T]TAGAGTCATTTGAGATAAATTCCAA | 864,477 | 92 |
| 2317. | GTTTTCTTATGTCTTGCATTTGTG[T,C]AACTTAGGTTGTGGGAATATTTGGC | 864,562 | 92 |
| 2318. | GTGGGAATATTTGGCTTCACACAA[G,T]AAGATCATATTGGAAAAATTAGCTT | 864,597 | 92 |
| 2319. | AGTTATTTTAGCTTTCTAGTCTAT[A,G]TGTACAAGGCTTCGTGTGTGTCC | 864,700 | 92 |
| 2320. | CCTAGTTCATTTCCACATCTCTTC[C,T]CTGGAAAGGACCAGCTTCGTTGCTT | 864,856 | 92 |
| 2321. | GCATATGCTCTATAGTAAAGATTG[A,G]CATATCCCCACTAATTAGGTTATTG | 864,972 | 92 |
| 2322. | ACAACACATCTTGTCAAGCAGTGC[C,A]GTGTCATTTCATCCAGTATTAAAAC | 865,497 | 92 |
| 2323. | GTGCCGTGTCATTTCATCCAGTAT[T,C]AAAACATTGAATTGTCAGGATACTT | 865,517 | 92 |
| 2324. | TGTCAGGATACTTCAAATTTCCTC[A,G]TTTTCAAAGTGTCCACTTGTCGCTT | 865,554 | 92 |
| 2325. | TATTAACTGTGCATGAAAATTTTG[G,A]CACAAGTATCCATGTTATCTGTTGA | 865,687 | 92 |
| 2326. | TCTGGAACTTCTTTGCTTGTCCAT[T,G]TGTATGATAAGCAACCAGGAGTTGT | 865,787 | 92 |
| 2327. | ATCACCTGTATCTAATAGTTGATC[A,G]TTATAGCTTGACTTCTTGATCCACT | 865,934 | 92 |
| 2328. | GCCTTTGTGGGAACTATTAGATGC[T,A]CCATCCATCATATATGCATAATTTG | 866,261 | 92 |
| 2329. | TTGTTGGTGTTCCATGGTTCCACC[G,A]GTATGTGCTTTTTAAAAGCATTCTT | 866,325 | 92 |
| 2330. | ATTTAAGGCATTGTGAGCCATACT[G,A]GTAGCAAACTGAAATGGTTTAGACG | 866,415 | 92 |
| 2331. | AGAAGAGGGGAGAGGAAGATAGGA[C,T]GACGCTGTTGGAGGCCAGCGGTGGC | 866,516 | 92 |
| 2332. | GGGGAGAGGAAGATAGGACGACGC[T,C]GTTGGAGGCCAGCGGTGGCCCGTCG | 866,522 | 92 |
| 2333. | GAGGCCAGCGGTGGCCCGTCGAGG[T,C]TGGCCGGAGGGCCACGTTGGCCTCT | 866,551 | 92 |
| 2334. | AGGGCCACGTTGGCCTCTGCAGCT[T,C]GATGTCGCCTGATAGGGCATTTAAA | 866,583 | 92 |
| 2335. | GGAGGGATGTGCAGCTGGCGGAGA[G,T]GTTGTCAGAGGGCACCAGATGACTG | 866,671 | 92 |
| 2336. | GATGAAATAGGGACGATCGCCCTT[A,G]TTTCATGTCCGCGGTACCATAGGCG | 866,885 | 92 |
| 2337. | GCTGGCCAGCACAGGTCCCGATTT[T,C]GATTCCGGTTCTGCCTTCCTTGTTT | 867,138 | 92 |
| 2338. | ATCTACTTTTACATGATTGCTGGT[G,C]GATGATGCGTGCCTTGCTCTTTATT | 867,343 | 92 |
| 2339. | TGCTGATTGGATGACGAGCTGTGT[A,G]ACCAGTCACACTGGGACTACATTAT | 867,428 | 92 |
| 2340. | TATTCTCTTTCTTTGTTGTTTTGT[C,A]ACATGTCTTGGTATGACTAGTTCCA | 868,404 | 92 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 2341. | ATGTTCCAACCTTTTCCCTTGTAT[T,A]CTATGATATTAGCCTCATTTAGCTG | 868,553 | 92 |
| 2342. | GCTTTAATTGAATCATCATTCTTC[T,C]CTGCTCTTCAGGTATTTAAGTGAAA | 868,708 | 92 |
| 2343. | CATCAGCTATAAAGGACACTGGGG[C,G]CCTGAGCAAGCATTTAACTGTATAA | 869,084 | 92 |
| 2344. | AGCAAGCATTTAACTGTATAACAA[G,A]TTTTCTTCTTTATTTTGTAGATCAA | 869,113 | 92 |
| 2345. | CACAGGCAATCTTCAAAGTCTTCC[A,G]GACATGTTTACTCCTTCAAATTATG | 869,488 | 92 |
| 2346. | ACAACTAGTGAAGGCGAAATATTA[T,C]CTCTTCAAGGTTTAAATTCTTGTCA | 869,586 | 92 |
| 2347. | TGGGAAGAAGGAACATGCTTTATA[T,G]AATGCACAGAAAGGTCAAATTTATA | 869,765 | 92 |
| 2348. | TAACGTGATACTACCACAAGATAT[G,A]TGCGTTGATGTGCCACATCCCTTAT | 869,882 | 92 |
| 2349. | CTCGACTAGGTAAGCACTATGCCA[T,G]GACAAATGGTCAGCAGTACTCTGTG | 869,955 | 92 |
| 2350. | TAGGGAATGAGATCTATAGTAAAT[A,C]AATAATTTTCTCTACATGTTCATCT | 870,056 | 92 |
| 2351. | AATCCACTCTCCATCTATCAACCT[T,C]CTTGATTTTCTTGTAGACGACTACT | 870,186 | 92 |
| 2352. | TCTTGTAGACGACTACTTAAATTT[T,C]TCACTTTACCATTTGAGTATGTTC | 870,219 | 92 |
| 2353. | GAACCTGAATATGAACAGGGGGAG[A,G]CAGGAAGGATGTCAGCAAGTGATCC | 870,322 | 92 |
| 2354. | CCAAAGACATAAAAAATAAGGTTT[G,A]TCTTCTATGTAGCATCCCAATTTTT | 870,401 | 92 |
| 2355. | ATATTTCTTTATGTGTGTTATGTT[C,T]CAATGTTTATTAAAaTTAAGGTGT | 870,451 | 92 |
| 2356. | GTTTTACTTCCCATTGGTTCCAAG[T,A]CTAGGATCAATATCTTTTtCTTTAC | 870,552 | 92 |
| 2357. | TCAGAGTAGGATACTGTTTAGCGT[A,T]TGGAGAATCCTTTATACTGGATGTT | 870,681 | 92 |
| 2358. | GCAGGTTGATTTTTTCCAATGTAT[A,C]ATTTtTTTTTTtGCAAGGCTATGAT | 870,891 | 92 |
| 2359. | GCTCATGAGTTTCTCTAAAATACT[T,C]TAGTCAATGGCGGATGTTCAGTTTT | 870,944 | 92 |
| 2360. | TTTATTTTATAATGTGTTAAAATA[G,A]AATTTGGCTGTTTATAGAGTTCTGA | 871,226 | 92 |
| 2361. | TGTTTATAGAGTTCTGAGGTCCTC[A,G]CTCCTTTTTTtCTTGAAACACATAT | 871,259 | 92 |
| 2362. | TTATAGAGTTCTGAGGTCCTCACT[C,T]CTTTTTTtCTTGAAACACATATCTT | 871,262 | 92 |
| 2363. | TCTCCTCTGTCGACGTAATAATGT[A,G]TTCATTTTAAACTCTTCTTTTGTTT | 871,361 | 92 |
| 2364. | CTTTTGTTTGTGTTCTTCACAACC[T,C]ATTCAACAATTTCTTCTTTACCATT | 871,402 | 92 |
| 2365. | AAATAATCTTTCTCCCCACTCCCC[G,C]TTCCCAACTGATCAATTATGACCTA | 871,697 | 92 |
| 2366. | CCAGAAGGATGTTGGTATTGACAA[T,G]AAATTAACAAAATGCCATGTTTGCA | 871,798 | 92 |
| 2367. | TCCATTCAATATCAAAAAAaTAAA[T,C]ATATAAAAGATAGAAATATAATTTA | 871,906 | 92 |
| 2368. | AAATCTTGATTCTTTCATCAGCTT[C,T]CATGCAACACCATGGTAACCCTGAT | 872,041 | 92 |
| 2369. | AACACCATGGTAACCCTGAGAATC[T,C]GAAAGCAATCCAGTTTTTGGATGAG | 872,071 | 92 |
| 2370. | TGGGTCTGGTTGTGTCCAGGTCAA[C,T]CTTTGTGAAAGCTGAACTAGCCCAG | 872,471 | 92 |
| 2371. | ATACTTTTCTTTGTAGGTAATA[G,C]ATATGCTTTTTCTGGTGGCCAAGAT | 872,609 | 92 |
| 2372. | AAATATATGGCATGAGAGATAATT[T,G]TAGTAGTTCATTTTACTATATTGAT | 872,761 | 92 |
| 2373. | GTTAACTTCCTCCACTGTGGGTAA[G,C]TTATACATGAATAACCTACTTGTCT | 872,948 | 92 |
| 2374. | ACAGGTTTATATATTTTAGTTTAT[A,G]TTTATTCATAAGAAAAAAaTGAAAA | 873,172 | 92 |
| 2375. | TTATATTTATTCATAAGAAAAAAa[T,C]GAAAAACATTCATGAGAACCAATTT | 873,192 | 92 |
| 2376. | ATACTCTTCCTTCTTGCCCCAGTG[C,T]AGGTACTTTGTTGGCACCTGGGATT | 873,337 | 92 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 2377. | ATCTCTTCCTTCTTGCCCCAGTGC[A,G]GGTACTTTGTTGGCACCTCCCATTC | 873,338 | 92 |
| 2378. | ATGAGATTCATGACTAACAATTCT[A,T]GATTTTTTTtCCCAGATGGTGGAT | 873,421 | 92 |
| 2379. | GGATTAAAATGATCAAACAGCAGA[C,G]TTTTTCTGCTTTACTGATTATCACT | 873,553 | 92 |
| 2380. | CGATTGACACTCAAAATACTTTTT[G,T]GTGTTACACAAGTATTCCTGTTCTC | 873,788 | 92 |
| 2381. | ttCATGTAACAGTGCTTCATAGCA[G,T]GACTGATGGGATTGTGAATGGCTGT | 874,221 | 92 |
| 2382. | AATATAATTTGAAGATATCTGTTC[G,C]CTGTACCTGTTTGGTAACTGGTCGC | 874,429 | 92 |
| 2383. | TATCTGTTCGCTGTACCTGTTTGG[T,A]AACTGGTCGCTGGGTGTAAGTGAAT | 874,444 | 92 |
| 2384. | GTTGCAGTTTTCCACACGCATTCT[C,A]AGCCATTTTCTTACAGGGTATCAGT | 874,498 | 92 |
| 2385. | TCTGTGGGCTTTTCACCAGCTCTA[A,C]TTGGTTGCCTTGAGGAAAAATTGGA | 874,591 | 92 |
| 2386. | AAAATTGGATCATTCTTTATACAA[T,G]GACCGGTAAAGAAAAaTAAAAaTTT | 874,632 | 92 |
| 2387. | TGTAATGAGACCAAGAACCATGTA[T,A]GGAATTTAATTTTTGCTAGCAAATA | 874,779 | 92 |
| 2388. | ACCAAGAACCATGTATGGAATTTA[A,G]TTTTTGCTAGCAAATATTAAAAAaT | 874,788 | 92 |
| 2389. | TCCTCTTTTTCTCTCTCCATTTTT[C,T]TCTTTTCAGTTTTCGTAGTTAGGTT | 875,442 | 92 |
| 2390. | TTTTCTCTCTCCATTTTTCTCTTT[T,C]CAGTTTTCGTAGTTAGGTTTCTCAT | 875,448 | 92 |
| 2391. | CAGGGTTTTTGTTACCAAAAGGAT[C,G]TATCACCACAAAAGGTGCATCTTGT | 876,103 | 92 |
| 2392. | TTAACGTATCATTATATGATTGTT[T,A]ATGGAAAAAATGTGAGCAGTTTTCT | 876,184 | 92 |
| 2393. | TCTTGTTTGTATATGTGAGGCAAT[T,C]TTAGAAATAATTATAAGTTGCACCT | 876,231 | 92 |
| 2394. | TGATTGTTGAAAATTAAAAATATT[A,T]TAAGAAATATAGCATAATACATGGG | 876,537 | 92 |
| 2395. | TAATACATGGGTATTGGAATTTGA[T,C]CTCTCCAACATTAATTTAAAGTTTC | 876,576 | 92 |
| 2396. | ATCAAGAAAGGTTCTGAGTGGCTG[T,C]GCCAGTCACCCAATGGCATACTATG | 876,901 | 92 |
| 2397. | GAGATGTTCTTTTAGTTAATAAaA[A,G]TAaAAAAATGGAGTTAAATGGCATT | 876,998 | 92 |
| 2398. | AATAaAAAAATGGAGTTAAATGGC[A,G]TTGCACCAGCCCATTCCTTGTGCCA | 877,021 | 92 |
| 2399. | CCAGTATTGGACTAGCATGATGAG[T,C]CAAGCTATATTATTGGCACTTATCT | 877,068 | 92 |
| 2400. | ATGAGTCAAGCTATATTATTGGCA[C,T]TTATCTTGAGCAAAAGTATCATCGG | 877,087 | 92 |
| 2401. | TCGGCACTTGAAACCATGATTCTG[G,A]GCATGTTAGATtTTTTTATTCTTTT | 877,133 | 92 |
| 2402. | GCTCTTTGTAAAACTGCTTGATGA[T,A]TTTCTGTTGTACGATATATCACAAA | 877,230 | 92 |
| 2403. | ACTGCTTGATGATTTCTGTTGTA[C,T]GATATATCACAAAGGTAGCCACACA | 877,242 | 92 |
| 2404. | TAGAGTATATTGGCTTTGTGTTTG[G,A]AGTGTTGCTCAAAATTGCGACCAAA | 877,409 | 92 |
| 2405. | TTCAAAATAAGTCCTGCAGTGCTA[A,C]ATATTAAATTCGTAAATCATTGGC | 877,645 | 92 |
| 2406. | TATAGATTTATTTTATTTTTCGTC[G,A]CTTTTTCTCTTAATTTCTTtTTTTA | 877,843 | 92 |
| 2407. | TAGATTTATTTTATTTTTCGTCGC[T,C]TTTTCTCTTAATTTCTTtTTTTACA | 877,845 | 92 |
| 2408. | ACTAAAGCTGGTGTACTGAGGATG[C,T]GTGGTGCTTTTTGTTTGATGATTA | 878,175 | 92 |
| 2409. | AATAAAGAGCCAGCATTACTATTT[C,T]GAGAAACATTTGGTTGATGGTTTAC | 879,200 | 92 |
| 2410. | TTACTATTTCGAGAAACATTTGGT[T,A]GATGGTTTACTATGTTTTGTTCATG | 879,215 | 92 |
| 2411. | GGAAATCTTTCTTAAACAGACAGC[C,A]GGATCATACTCCTTTGATTGTATCT | 879,348 | 92 |
| 2412. | GTTTTTGTCTAGACAGGGAATCTT[C,T]CATATTCTAAATATGGACCTATTCC | 879,558 | 92 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 2413. | AAGATATGTGGTTCATTCTTGAAT[T,A]AACTGAGCACTTGCAGCTGTTATGT | 879,632 | 92 |
| 2414. | AGCTTCAGCAAGAAGGTTGTTTGT[T,C]CTCCGGGTTCTACTTCTGAGTCAAG | 879,791 | 92 |
| 2415. | TTTATTATTTGCTTCAGGTGATGC[G,A]CTGCACACCAGTCCTGATGGTTGGC | 879,907 | 92 |
| 2416. | GAAGAAGATTTTGCAAAGGCAAGT[C,G]TGGGTTTAGAACTAGATGCAGGTAT | 879,978 | 92 |
| 2417. | ATGTGAGGATCTGATATTATGATA[G,A]TTAATGAACGAGAAGCAGTTCTGTT | 880,305 | 92 |
| 2418. | TTTTGCTTTCACATCTGAACATGA[A,C]AAAGAGGTCAACATAGTTTATTTTG | 880,358 | 92 |
| 2419. | GTTTTGTTATCCAAGCCTCTAGAA[T,C]AGATTTTAGCTGATTCAATCTGAAC | 880,407 | 92 |
| 2420. | AGGAGAAGAGTAGGGTAATGAGCC[G,A]TGAACAATAGTGCACAAGTGAGCAA | 880,509 | 92 |
| 2421. | AGCAACAAGGGATTACTCTATGTT[T,G]AAATAATCAATTTTGAATTGGATCT | 880,554 | 92 |
| 2422. | AACCCTCTAAAAAGGGCAACCATT[A,G]TTAAATAATCATTTCAAGAGTATTC | 880,748 | 92 |
| 2423. | GCATCAGTATGCCCTGTATCCTGC[T,G]ACAACTTAAGTGCCCATGCTGTTAA | 881,061 | 92 |
| 2424. | ACCTTATCAAACTGGTATCTCAGC[G,A]TTTGTGTCACTGTTTCACCCAATTA | 881,350 | 92 |
| 2425. | ATCTGAAAATCTAGCACCTGTGAC[A,C]GCACACATTTTCTGTCAGATTAAGT | 881,416 | 92 |
| 2426. | CTTAAGACTTCATGCTTCAACGAT[C,T]CTCAACATGGCTAAATAAACAATAG | 882,012 | 92 |
| 2427. | AATGCAGTGCATTCATTTTGTTGC[A,T]GCTCCCCTGCAAAATTGGGATTATT | 882,168 | 92 |
| 2428. | TCCTTATGAATAGCATAAAACTCT[T,C]ATGCCACATCGGATGGGTTATTGAG | 882,303 | 92 |
| 2429. | GGCCTAAGTGGTTGCTCAAGGCAC[A,G]AAACCTGCATTCCAGGTCACGTTTG | 880,536 | 92 |
| 2430. | CAAAACCTGCATTCCAGGTCACGT[T,C]TGAATATTTTTGGAATGAATCATAC | 882,559 | 92 |
| 2431. | AATCATACTAATGAATGCTTTCTT[T,G]GATGGAATTTGTAGCAATAAACATC | 882,601 | 92 |
| 2432. | ATCGGGTCCATACTGGTCTTGAGC[T,G]GGAACAGTATGGTACTGGTACAGTT | 882,768 | 92 |
| 2433. | ATCCTTTCCAATCATTGTCAAACC[A,G]CAAATCGCATGCGGGGTTGCGGATG | 883,050 | 92 |
| 2434. | AATCTTTTTATCTTCCAGTTGGCT[C,T]GACTGACAACTGACAAAGTGCAACT | 883,284 | 92 |
| 2435. | TGACAACTGACAAAGTGCAACTTC[G,A]GCTATAAAAGCTATTTAGTTGATTT | 883,312 | 92 |
| 2436. | AAAAAAaaTTTATCTCCACCTTTC[A,C]GCTTTTGAGAAATGGATATACTCAA | 883,427 | 92 |
| 2437. | TTGCTGTTATTATCTTTAAATCAT[C,T]ATTGTTATTATATCTTTATCATTCT | 883,481 | 92 |
| 2438. | TTTAGTTAAGTTGGCTTCTTGCTC[A,C]AATCATTTTTtGTTTTCTTATCCTT | 883,576 | 92 |
| 2439. | AGCTATTCTTCAGGTAAACAAGAA[T,G]CACCTGCAGATGATGCATCATAAGT | 883,684 | 92 |
| 2440. | TGAATATCAAGAGAAATTGCGCTT[T,C]GTACATTGTGATTCAGTTTTTTACA | 883,773 | 92 |
| 2441. | ATGCTTTAGGTGTTCAGATGATTA[C,T]ACTGTCCTAAAACAAAAaTCTTAAA | 883,902 | 92 |
| 2442. | GAGAAGTATATAAAATGTAAATCA[G,T]GCTACAAACTAGAACTAATTTTGCT | 884,971 | 92 |
| 2443. | TTTCATGGTTCTTTTAAAGAACTT[G,T]AGAATAAAATTAGATTTGTAATCATG | 885,034 | 92 |
| 2444. | AATGTTTACGTTTGTTACAGTATC[G,A]ATCGCTCTCCAACCACTCCACATGT | 885,177 | 92 |
| 2445. | TCGATCGCTCTCCAACCACTCCAC[A,G]TGCTTTTGTGGGATCAGGTGTTGAG | 885,199 | 92 |
| 2446. | AGATCCAACAATTGCGAGCACAAG[T,C]CTTGGCCAAAAACAGTGACTTTACC | 885,299 | 92 |
| 2447. | TGGTTGCTCAAGTCAAAATCAGAC[G,A]TCATGCATCAATACATAGTTTAGGT | 885,448 | 92 |
| 2448. | AGCAGTCACTGCAGTGCCCTCAAT[A,G]TGAGAAGATCCAGTAGTTGGAGTGT | 885,500 | 92 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 2449. | GTTGCTGCCTCTGGACTTAAACCC[A,G]TGCCATTGCACTTGTCAGTGCAAGC | 885,716 | 92 |
| 2450. | TAGGAATTGAACCTACGCCATCAT[G,A]CTTGTCAGCCCAAGTCTTTTACCAT | 885,905 | 92 |
| 2451. | CAGCAATAGCCTCTTTGCAAGGTG[A,G]CAATTGGAAACCTTACCATCAACCA | 885,961 | 92 |
| 2452. | AAATGGGTCATGTAGGCCATTAAG[T,C]CACAATGGATCAGTCCTACTTCAAT | 886,082 | 92 |
| 2453. | TTTGAGTTGTGTTATGGGTTAGGC[C,T]TGAAAGATTTTGGACTGGTTTGGAG | 886,317 | 92 |
| 2454. | GGCCTGAAAGATTTTGGACTGGTT[T,C]GGAGTTAAATACAGAGCCCATATGT | 886,338 | 92 |
| 2455. | AGTTAAATACAGAGCCCATATGTT[C,T]TTTGGGTTGGGCTCAGGTATATCAT | 886,365 | 92 |
| 2456. | AGGCCCAAAATGGAGCTTGAACTC[C,A]AGCATGAAATGGAGTCCAAACTTAG | 886,454 | 92 |
| 2457. | TCTGGTAAATATGTTCTGATCATC[G,A]GATGGTTGCTAACATGAAGCTACAG | 886,569 | 92 |
| 2458. | GGATGGTTGCTAACATGAAGCTAC[A,G]GTATTTTATCAGAAAAAATGTGAAG | 886,593 | 92 |
| 2459. | CTTCAATCGGGTTTGGGCCAGCCC[T,A]ATTTTTATCCCAAATGGATAACTTG | 886,671 | 92 |
| 2460. | TCAGTTGTGATATCTTAATGCATC[G,A]TTGGCATCAATAGGTTATCCAGATT | 887,077 | 92 |
| 2461. | TGCATCGTTGGCATCAATAGGTTA[T,A]CCAGATTGGGCTACATCATGCAAGT | 887,095 | 92 |
| 2462. | TACATCATGCAAGTTTGATTAACC[A,T]ATAAATTAGTTCTTTGTGCTTCTAA | 887,131 | 92 |
| 2463. | TTAGTTCTTTGTGCTTCTAAATGG[T,C]GAGAGCAACTTTTCTGGACAGAGAA | 887,161 | 92 |
| 2464. | TCCAAGAAGACCTTTGTTGATGGA[C,T]GAGCAGAATACATGAGAGGTACAAA | 887,219 | 92 |
| 2465. | AAATCTGTTGTGGAAAAACAGCCC[G,A]GTCACAAAACCTGAAAAATGCTTTA | 887,508 | 92 |
| 2466. | TTTTCCTGATTTTTCCATCAAATA[C,T]ATTTTGCCCAAAATCAAGTTACAAA | 887,578 | 92 |
| 2467. | AAGAAGATAAAAGATCCGGAAATC[C,T]ATTTTGCCCAAAATCAAGTTACAAA | 887,745 | 92 |
| 2468. | GAAGCAATATTTCGGAAGATGGCT[T,C]CTTGGCTCCCTGAGTTGTCAGACAT | 887,800 | 92 |
| 2469. | ATTTATGTTCAATTTTTTGTATTA[T,C]AAATATTTTTCTTGGCATCTCCTTG | 888,137 | 92 |
| 2470. | ATTTTTTGTATTATAAATATTTTT[C,T]TTGGCATCTCCTTGTTCTTACAATT | 888,148 | 92 |
| 2471. | TCTTTGCATGCCCATCCACTACCT[A,G]CCATCTTCTAAAACATCGGTATAAA | 888,266 | 92 |
| 2472. | ATAAAGCCATATGTTTCTAAATGC[C,A]CAATGAAAGAAGCTAAACAGAGATT | 888,311 | 92 |
| 2473. | ATTTGGGCATCATGGGTTCAAACA[T,C]GAAAACAGCCTTTCAGCATACGGGG | 888,428 | 92 |
| 2474. | GGGCAAGACTGCTTACATTTAACC[T,C]TCTCCAAACCCTGCAGTAGTGGGAG | 888,476 | 92 |
| 2475. | GGCCAATTTGAAGTTTGAAACCTG[A,C]GTGGATTATTCTAGATATGCATGTT | 888,601 | 92 |
| 2476. | CTGGAGGCACTTGACAAGATTATT[G,C]GAGATGAAAGTTATAATTTTGATAA | 888,948 | 92 |
| 2477. | AGTAGAATTACTTTTATTAATTCG[C,T]AGTTATTAATAGAGATCCTAAATGC | 888,999 | 92 |
| 2478. | CCTGCAACTATCATGCATCCTAAT[C,T]GCTATTCACAGTTGCTGTGTAGAAC | 889,152 | 92 |
| 2479. | TATTCACAGTTGCTGTGTAGAACA[G,T]GCAAAAAACTGAAACCTATATAATA | 889,179 | 92 |
| 2480. | GAAAGAAAGATGAGAAACCAAC[C,T]ATCCCTCCATAATTGGTTTCTGGTT | 889,329 | 92 |
| 2481. | CACCTTCACACCTTGTCTGCCCCA[T,A]GGCTAGGCGACTTCACTTGGGCATT | 889,609 | 92 |
| 2482. | TAGGCGACTTCACTTGGGCATTCA[A,G]AAAGCATGCCTTTTATATGCCTTGC | 889,637 | 92 |
| 2483. | AGAAAGTACATTGTACTGTTTTT[G,T]ATTAGGAATTTGGTGATTAACCAGA | 889,699 | 92 |
| 2484. | TGGTGATTAACCAGAAGAGAGAAG[G,A]GGGAAAGATATTGTAGAAAAAGGA | 889,734 | 92 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 2485. | TTCTTTTTCTTCCATTTGATAAAT[T,C]CCTTATTCTTCCTGTTCTTCTTCTC | 889,861 | 92 |
| 2486. | TTTTCTTCCATTTGATAAATTCCT[T,A]ATTCTTCCTGTTCTTCTTCTCTTTT | 889,865 | 92 |
| 2487. | GGCCCTCCTCTGCTGCTGCAACTA[T,C]TGACTGATGCTTCTGTGCTCATATG | 889,959 | 92 |
| 2488. | CAACTATTGACTGATGCTTCTGTG[C,T]TCATATGTATGTGCGTATGCATGTG | 889,977 | 92 |
| 2489. | GCTCATATGTATGTGCGTATGCAT[G,A]TGTACATATATGTATATGTACATAT | 890,000 | 92 |
| 2490. | TTCCACAGCAGCTCAGAAGTTCAG[C,T]AATGATTTAGCATCAAAAACTCTGC | 890,150 | 92 |
| 2491. | ACATTTCAGAAACAAGATATAGAG[T,C]GACATGGTTTAACTGTTTGCTATTG | 890,872 | 92 |
| 2492. | TAACTGTTTGCTATTGATTTTTAA[T,A]GAAAATATATATGAGAAGTTTTTCT | 890,906 | 92 |
| 2493. | AAAATAACAGAAAATTTCAATTAA[A,G]AATATAAGATGTAATTTTAAAATTG | 891,073 | 92 |
| 2494. | GGTGTTTCTTCACGTTTTCACTCA[A,G]GGGGCCAAAGAAAGCATAGACTTCT | 891,150 | 92 |
| 2495. | ATCCTGGCTCTACCCTTGCAATGC[G,A]TACCAAGTCCAGCACTCCAGTTTGG | 891,220 | 92 |
| 2496. | GAACTTAAATTGCAACTAGCCAAC[T,C]ATACTCATGGCAGCTTGATGAATAC | 891,360 | 92 |
| 2497. | TGGCTTGGCCATGCACATCAGAAG[T,C]CTTGTACGAGTGCCTGCTGATCTCC | 891,427 | 92 |
| 2498. | TGCACATCAGAAGTCTTGTACGAG[T,C]GCCTGCTGATCTCCCATACAAAATT | 891,438 | 92 |
| 2499. | ATTGCTTTGGTATTTGGACTCGAC[G,A]TTCCAACTTATAGTTGGCTCTACTT | 891,532 | 92 |
| 2500. | TGAAGTCTCTTCCAGTTGCTACTG[G,A]GGACCAGTTCTCAGCAGGTGGGCCA | 892,041 | 92 |
| 2501. | CCATGCCTTTCTCTACTGAAATGT[T,G]TAAGCTGTAATACTGCTGCTGCTAG | 892,199 | 92 |
| 2502. | TAACCCATTCAAATTTATCGCGGG[T,C]CATGAGATAAACTGCATTTCCTAGA | 892,641 | 92 |
| 2503. | CCACAAAATTCACCATGGGCTGTT[A,T]TATCATCATGGTAGCAGATATTTGA | 892,745 | 92 |
| 2504. | ACTATTCTCATCACTTTTCACGTT[C,G]AGCCTGCACCAAAGAATAAACCTTT | 892,974 | 92 |
| 2505. | CTGTAGGCATAATAGCTTCTTTCT[T,C]ATCTGGTACACAAACTATTTAGCTG | 893,059 | 92 |
| 2506. | TCATGATTCTCAGATTCCCATATT[C,T]CAAGAAAAaCCAAAGCCAAAACAAA | 893,172 | 92 |
| 2507. | GATCGCAGGCCCACTGGAAAATGG[A,T]GCTCAGAAAGGTGTGTCTCAGTTTC | 893,693 | 92 |
| 2508. | TCTCAGTTTCTTTATCAGATCCAC[A,T]GCTCAGAAAGGTGTGTCTCAGTTTC | 893,733 | 92 |
| 2509. | CAAGCGGATCTGCTGCAATTCATG[C,T]TGCATTGGATCCTCTCCATGCCAGG | 893,756 | 92 |
| 2510. | CCATTGGTTTTGGTTTGTTGGGGG[A,G]AACGCCTTATGGCATGTTACAGTAG | 893,871 | 92 |
| 2511. | TAACTTCAGATGATCTGGCCGATA[G,A]AGCACCTTCGTTGTGGTTCTTAATC | 894,029 | 92 |
| 2512. | TGTCAAATGACCGGAAACTTCATA[T,C]GTAGTGCATCAAGAAATGTATCCCA | 894,082 | 92 |
| 2513. | GTCCAGGAAGTTGAAGGTTTTTCA[T,C]AAAGAAAGCCGCCAGTCTGCTTACT | 894,185 | 92 |
| 2514. | TCACTTCCTCCAGGATTATACATC[A,T]AAACTTTTATTCTGTTTTTACAGAA | 894,317 | 92 |
| 2515. | CAAAGATCGCCACTTAAATTAACC[A,G]GCAGTTTTACCTTTCAAGCTTCTGG | 894,446 | 92 |
| 2516. | ACATTTGCAATTTTCTTGCCTGT[T,C]TGAGAGGTTGAAGTTGAAAAGAAA | 894,683 | 92 |
| 2517. | AGGTTGAAGTTGAAAAGAAATCA[C,T]CAGCATTAGCCAGAACCAGTCATAC | 894,712 | 92 |
| 2518. | GTTGGGTAAATTTGATTTCTGCAG[A,C]TGGAGAAACCTGCAAAGCAAATAAT | 894,861 | 92 |
| 2519. | TAAATCTTAACAAAATTTCCTGTC[C,A]AATCACAAACATCACCTATGCAGCG | 895,196 | 92 |
| 2520. | TAAAGATATGAATTCCTACTTTAC[A,G]ATGCCACTCTTATGCACCAGCATCG | 895,348 | 92 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 2521. | ATGCCACTCTTATGCACCAGCATG[G,T]TCCTGAATGTTCCCATCAGACTTCT | 895,373 | 92 |
| 2522. | GAGCAGGTAATTATCCTCACTTTC[A,G]TCCTFAGGACCAACAAAGCGTTAGG | 895,577 | 92 |
| 2523. | ATCCTCACTTTCATCCTGAGGACC[A,G]ACAAAGCGTTAGGGCATTACATATA | 895,589 | 92 |
| 2524. | AGTGATATTTTTATAGTCAAAATA[G,A]TATACCATCAGGCCAGGCTCATTTT | 895,464 | 92 |
| 2525. | TATAGTCAAAATAGTATACCATCA[G,A]GCCAGGCTCATTTTCTGGCTTAATC | 895,657 | 92 |
| 2526. | TGAGAACTCACCGTCATCTGTGTC[G,A]CCTGAATCCAGAGGGATGCCCTCAT | 895,848 | 92 |
| 2527. | AGCAACAACATAGAAGGGCAGATA[T,C]TAGGAGGGTTAGAGGTCCAATCACT | 895,986 | 92 |
| 2528. | ATAACATATTCAGGTAGTCACTGC[A,G]AAGCAGTTTTTCTCTATCCTGAATG | 896,338 | 92 |
| 2529. | CTAGATCACAGTGAAGCAACCTTA[C,T]AGTTGTGCCATGGCTCATGCTCTAG | 896,730 | 92 |
| 2530. | ATTCCATTGTTGGATGATGGTAAA[C,T]TAGGTGCTTGGTTAAAGCAGCAAAT | 896,937 | 92 |
| 2531. | TGTGCACTGAGGTACACATATAGG[A,G]CCCCATACCAAGATTTAAAGCATGG | 897,084 | 92 |
| 2532. | ATTGTCCCACTTTCAAAAAATCAT[C,A]ATTGCAGTGCAAAAATGGTGTTGTT | 897,927 | 92 |
| 2533. | ACGAAGTTCTTGGGCAACACATGG[G,T]AGCATCAATCGCAACTGGCAGTTTA | 898,138 | 92 |
| 2534. | CTCAACTATGTATATACTGGTACT[A,C]GTAGCATTTGATATGCTTATTTTG | 898,836 | 92 |
| 2535. | ATTTTATGGCATTTTATGGCATAC[C,T]GTAGAATATAATTAAGCACCAAAGT | 899,058 | 92 |
| 2536. | TTATCCCAGAAGGAGGTTACCACT[A,T]TCTAAACAACATGAATTATTGATGA | 899,207 | 92 |
| 2537. | TTAAGAATTTTCATTTCAAGCATA[G,A]TAGCTTCAGCAAGAGGAATAATATT | 899,807 | 92 |
| 2538. | AAATGAATAATTtTTTCTAGTGAT[G,C]ATTATTTTGTATTTACTTACCTACA | 899,912 | 92 |
| 2539. | ATATTTGCACAATCTAACATTATT[A,T]TGAAGGTTGATTGGAATATCTGAAT | 900,482 | 92 |
| 2540. | AAATGGAAAAGAACTAAGCCTCAT[A,G]ATTGGCAGCATTTACAATGGAGCAA | 900,600 | 92 |
| 2541. | TCTACCTGAAAAACTATTAGTTTT[C,A]TACATTCTGGTCCACTGTGAGATAA | 900,768 | 92 |
| 2542. | ATCCTAACCTAAATTTCAATGATC[G,A]GTGTTTCTGCATTTTCACCAAGCTA | 901,313 | 92 |
| 2543. | GCATTTTCACCAAGCTAGAACATA[T,C]TGTCCGCGCAACAGGAAAGAAAATG | 901,346 | 92 |
| 2544. | TTTGGTGCAACACGTAGGGGCACC[T,G]ATTAGCAGAAATCAAAGAACGTCAA | 901,570 | 92 |
| 2545. | CGCTGAAACCCTCCCAACCCATCA[C,T]AGTTAACGAACAAGATATAAATCAT | 901,691 | 92 |
| 2546. | ACCCTCCCAACCCATCACAGTTAA[C,T]GAACAAGATATAAATCATGAACAGC | 901,698 | 92 |
| 2547. | AATCGATGAAAAATATGTGATTAT[C,A]TAAAACTAAAGATCCAGAGCAAGAG | 901,914 | 92 |
| 2548. | ACTCGGAGTCCGGGGAGGTAGCAT[G,A]TAAAAGAGGTAGAGTGGATCCGCTG | 902,292 | 92 |
| 2549. | tGGTAGAAGAGAAGAGCAGTTTAA[C,T]GCAAATAAAATTTAACTCTGGTTAA | 902,729 | 92 |
| 2550. | TCAAGTAATAGCATTTTTTtCTTG[A,G]TCCATTTGTTAGCCATTCATGGTCT | 903,286 | 92 |
| 2551. | AATATATTTATATGAGTTAATAAA[T,G]ATTTTTGAATTAATTATATATTAAT | 903,378 | 92 |
| 2552. | CAAATACAAAAAAAaTAAATATCA[C,T]ATTTCTTGTAGTATTTATTTTATCT | 903,671 | 92 |
| 2553. | AAGCTTAGGGAGTGCATGTATATA[C,T]TATATGGAGCAACATTTAGCATTTAT | 907,042 | 92 |
| 2554. | ATAAATATATAAATATTATGACTA[C,A]ATAAATATATGTATATATGCAGCAC | 907,437 | 92 |
| 2555. | AAaTAAATTGAAATGTAAATCGAA[A,G]TAGAATGACAATGGAATGTGGTGAA | 908,165 | 92 |
| 2556. | ACTTTTTATTTTATATTTTATTAA[T,A]TATTTATTATTTACTATATTACATA | 908,346 | 92 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 2557. | ACTATATTACATACCTTATGTTGC[G,A]GTCAATCCCTGTAGCGCCTGTCGC | 908,383 | 92 |
| 2558. | TCCATACTAATCGAAATTGTATCC[G,A]ACAGAGATCCTCTGATGCTCAAATA | 908,459 | 92 |
| 2559. | ATGACAAAGTGTTAGCTCAAAATT[A,G]TCTTATCAATACTGTTCGTTTACCT | 908,546 | 92 |
| 2560. | GGCTATAATCATAGAGTTAATGGG[C,T]GGTTTATGCCTATTGATAGTCGTGA | 908,652 | 92 |
| 2561. | AATGGGCGGTTTATGCCTATTGAT[A,G]GTCGTGACACGTAGTCGATGACCAT | 908,670 | 92 |
| 2562. | TAGTAGGTCGACAGTCGTGGAGTT[C,T]CGAATGAGCGTCGATCGATAATTTT | 908,842 | 92 |
| 2563. | ATTTTGATATATCAATGATCATCA[G,A]TCGGATATTCACTGAGTCATCGTGG | 908,887 | 92 |
| 2564. | CGGTTGGTCAACTGATTGTTAGTC[G,A]GAGTATTGTGTTCATAAGGACGATG | 909,969 | 92 |
| 2565. | GTGGTCTGTCACGTTGGACGAAAG[G,A]AGTTGTCACGTGCTGTCTCGAGCCC | 909,106 | 92 |
| 2566. | GAGTTGTCACGTGCTGTCTCGAGC[C,G]CCGACTCGACTGCTGGTATTAATGA | 909,130 | 92 |
| 2567. | ATATGAGAGATCTTCAGCTATTTT[G,A]CTGTTTCGATAGCTGTGAAATCATC | 909,189 | 92 |
| 2568. | TATGAGAGATCTTCAGCTATTTTG[C,T]TGTTTCGATAGCTGTGAAATCATCA | 909,190 | 92 |
| 2569. | CTTGATGTTGCCACGTGTCGATAT[C,T]TGAGGAGATCCAGGTTTGATCGATT | 909,417 | 92 |
| 2570. | GCTTTACTTTGCATTTGTTAACAT[C,T]CTCTTCAACAGAAGGTTCTGCTGGA | 909,519 | 92 |
| 2571. | CCCCAGTACTAGGAGCTCCAGGGT[A,C]TTATTTCTCGCACCATCCTTTGACT | 909,575 | 92 |
| 2572. | ATCCGAACACAATGTTGACTGGCT[T,C]TGGGAGCAGTACCGTATCCCGGAGC | 909,802 | 92 |
| 2573. | ATTTTTCTCCTCTGGGTCTGGTCG[T,A]AATTTAATCGAGGACCTTCGGGTCG | 909,891 | 92 |
| 2574. | GTCTCTGTCCTGCTCAGTTGGCCC[T,C]GAATTCTATCCGGCTAATCATCAGC | 909,992 | 92 |
| 2575. | ATCTTTTATCATCGATCTTTCATC[G,A]TCTATTCATGGATGGAAGAATCAAT | 910,164 | 92 |
| 2576. | TTTTATCATCGATCTTTCATCGTC[T,C]ATTCATGGATGGAAGAATCAATTTT | 910,167 | 92 |
| 2577. | ATCGTCTATTCATGGATGGAAGAA[T,C]CAATTTTttTTTATTTCTTCTTTTT | 910,185 | 92 |
| 2578. | TCCAAGGACTGGCCCTAACGAGAA[C,T]AGTCGGATGGAGGCCAATGATCGAA | 910,266 | 92 |
| 2579. | CTGAAGGATATGGCAGTTTTACCG[C,T]AGTGAGAGCTGATGACCGAATAAGC | 910,330 | 92 |
| 2580. | ACCGCTGATATCCGCTCGCACGTA[T,C]GCTACCAAGAAAAAGGCAGCAGCTG | 910,518 | 92 |
| 2581. | AGATGGTTCCTGAGCCAATCTTGA[T,C]GTTGTCAGCCCTGACAATGCTTCCT | 910,649 | 92 |
| 2582. | ACTCTTTTCGACATTCGGATCTCT[A,G]AGGGTGAGTCAGCCTTGGCCAATCC | 910,969 | 92 |
| 2583. | AGGGTGAGTCAGCCTTGGCCAATC[C,T]GACATTGGCCAAGCGGCTTATCGAA | 910,994 | 92 |
| 2584. | GCCATCCTGAAAAGGCTGGCACTG[G,T]CCAATGCTGAGTTGGCCTCCGCACG | 911,525 | 92 |
| 2585. | AGGGGCTACACCGACTGAAGACGA[C,A]GCACCGACTGCACCAGAAGCTGCTC | 911,785 | 92 |
| 2586. | GAGCAAGGAGATGAAGACAACGAC[T,A]GGTGACAGGTGTAGCATTTTtATTt | 911,855 | 92 |
| 2587. | GTTTGACTATCGAATATCGATCGA[T,C]AAGTTGAATGTTCGATAGTAATTGT | 912,035 | 92 |
| 2588. | TTATTTGATAAACGATAGTAAGCC[G,A]AATATCCTTCGACCAATCGTAGTCA | 912,193 | 92 |
| 2589. | AAGCCGAATATCCTTCGACCAATC[G,A]TAGTCAACTCGGTATAGTTTCAATT | 912,212 | 92 |
| 2590. | CAATTAGAGTCGACTTTTACAGTA[G,A]AAAATTGAGATATAGTCGGTACTGA | 912,326 | 92 |
| 2591. | GTACTGAGATACAGTCGGTATATT[G,A]ATTTTTATAATAAAAATTGAGATAT | 912,369 | 92 |
| 2592. | ATGTATTGATTTTTACAGTGAAAA[A,G]TTAAAATATAGTCGATAAGAATTGA | 912,424 | 92 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 2593. | TtCTTAGGACCAAATCTCCTGGAT[A,G]GAAGATCTTCGGGTTTAACTTTTGC | 912,743 | 92 |
| 2594. | GGACCAAATCTCCTGGATCGAAGA[T,C]CTTCGGGTTTAACTTTTGCATTATA | 912,749 | 92 |
| 2595. | CTTGAGCTTGTTGTCGAACTTCTG[G,A]AAGTAAGTCTAGATTGACCCTCCAA | 912,837 | 92 |
| 2596. | ATCACTTTTATTCTATAAGCCAGA[T,C]TGAATGGCGATTTTTCCATTGGTAT | 912,956 | 92 |
| 2597. | TTTGAGTCCATACAAGATTATTCG[G,A]TTTGTCACTTTCACTTCACCGTTGG | 913,084 | 92 |
| 2598. | CTTCCATCTTACTTTCTGTGATTT[A,G]TATCAGAGGTCCGACTTCTATCCAT | 913,448 | 92 |
| 2599. | AGCTGACTAGTCGATTGATGCTGT[A,G]TATTTACATATTTTTGGCATGGTTC | 913,615 | 92 |
| 2600. | TTAGCCATTCATCAAAATATATTG[C,T]GAGGCCATCCATATGAGTCATTTAG | 913,860 | 92 |
| 2601. | TGATTAGAGCGTAGATCATTTTCT[T,C]CGCTCTTGAATATCTTACTTCGACA | 914,732 | 92 |
| 2602. | TCTTTCCGATGTGCTAATCTGTTA[T,C]GATCAATCTCCTATAGCGTCCGTCA | 914,885 | 92 |
| 2603. | CCTGCAAAATGAAGTCCACACTGA[C,T]CAAAATTGTATCCAGTGGGGACCCT | 914,948 | 92 |
| 2604. | TGAGGAGTGATGAACAGCAGATAA[G,A]AATATTTGAAATGGCAGAGTGTTAG | 915,014 | 92 |
| 2605. | TCATAACGGTTAAATATGTGGGTT[C,T]CGCATATTCTGGCATTATATGATCA | 915,223 | 92 |
| 2606. | TAGTAGGTCGGTAGTCGTGGAGTT[C,T]CGAATGAGCATCAGTCGATAACTCT | 915,346 | 92 |
| 2607. | TCGTGGAGTTCCGAATGAGCATCA[G,A]TCGATAACTCTGATATGCTGATGGT | 915,360 | 92 |
| 2608. | TCTACATTTGGTTTCTCTTTACTT[G,A]GTATGTAATCGAGATATTCGTTTCT | 916,080 | 92 |
| 2609. | GAATCAGAAATTATCCTCAATAAA[G,A]ATATTACCTTCTTTATGCATTATAC | 916,233 | 92 |
| 2610. | ATAATACATTAAATTAAATGTTTA[A,C]TAAATTATTTATTTTCATTTGATAT | 916,381 | 92 |
| 2611. | TTGTTGTGGCAAATAGTATTTGCC[T,C]CTAAAAACAATTTTCATATATAATC | 917,340 | 92 |
| 2612. | ATCTTTTACCGACTTATCAGTATT[A,G]CCGATATATAGTCGGTTTATCTGTT | 917,858 | 92 |
| 2613. | ATAAAAGGGAGTAAATGAGTAGCA[C,T]CGGATAAGGATAATTTCTGGGTCAA | 918,058 | 92 |
| 2614. | AAAAGGGAGTAAATGAGTAGCACC[G,A]GATAAGGATAATTTCTGGGTCAAGA | 918,060 | 92 |
| 2615. | TCGGAGGATTTTCGTCGGACACAA[C,T]TTCGATCTGTGAGGACTTGATTTTG | 918,161 | 92 |
| 2616. | GAGGATTTTCGTCGGACACAACTT[C,T]GATCTGTGAGGACTTGATTTTGCAG | 918,164 | 92 |
| 2617. | CGTCGGACACAACTTCGATCTGTG[A,G]GGACTTGATTTTGCAGGTGCTCTTC | 918,173 | 92 |
| 2618. | TAGTAATTATTTAATTTAATTTTG[T,G]TGGGCATGAATGTGAAGCTTTACAC | 918,299 | 92 |
| 2619. | CACTCTTGAAGGCTCATGTAAAAG[G,T]AATTAATTACGAGCTTGGCCACTTA | 918,372 | 92 |
| 2620. | TGTAAATTGCACAACTTGTACGTA[A,G]GAGTTATAGTTGAATAGATCAGTCC | 918,901 | 92 |
| 2621. | TACTGTTGTAATGAAAATAACTAA[T,A]ATTATTAGTCAAAAATTGGACTTTT | 918,986 | 92 |
| 2622. | CTTTGTTCTCAAAAGAACATATA[A,G]CTTAAATAATTGTGTTTGTTATTA | 919,161 | 92 |
| 2623. | TGCATAAACTTTTTAGGAAAAAAa[G,C]CAAATAGGATAATAGAGTCACTTTA | 919,736 | 92 |
| 2624. | CAAGGAGAAGCAGCTGAAGATAGA[T,C]AAAGCTTGTGCTACAACACAAAACC | 920,563 | 92 |
| 2625. | TAATTAGAAATGTCAGTTTGATAC[A,G]TTTTAAAATACAGAAAATGTAAGTG | 923,791 | 92 |
| 2626. | TGTAAGTGAAATTGAATTAAAATT[A,G]AGAAGATATTTTTATAATTTTTtA | 923,833 | 92 |
| 2627. | CATCTCCATTTATTATATCACACT[T,C]ACTCTCTCCCTCCCTCCTATTTTTC | 924,159 | 92 |
| 2628. | GCTTTAATATTAGTTGGTGGTTTC[G,A]GTTAAGAAGGTCAAATACTTTGGGA | 927,283 | 92 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 2629. | GTTCCGAACTCTTCACTTGGAACT[C,T]ATGAATCAAATAGGCTGAGCTTAAA | 930,533 | 92 |
| 2630. | CAATGCTTATFCTACTGCTGAGAC[G,A]TGACTCAGATAACTTGGCTCGGTGA | 930,994 | 92 |
| 2631. | GATAACTTGGCTCGGTGAGTAGGC[A,G]ATTATGAAGTAATGTTGGATTCATT | 931,026 | 92 |
| 2632. | CAATTATGAAGTAATGTTGGATTC[A,G]TTAATCTTGTTCTGAATTTTCTCCC | 931,049 | 92 |
| 2633. | TCCATGTTTAGCTGTAAGTTTATG[A,C]ATAATTCATTTATCAACGAAAAGTG | 931,143 | 92 |
| 2634. | GATCATCCGCTGTTTTGAACAAAA[C,G]AAAGAAACCTTTCAGTATCATAAAT | 431,198 | 92 |
| 2635. | TGTGCTACATGAAAAGAGCTGACT[T,A]ATGCTAAGAAAATTTGAGAGCTTCC | 931,573 | 92 |
| 2636. | TAAGAAAATTTGAGAGCTTCCCAC[G,A]TTCATTTAGAGGAAAATTTCTTGAT | 931,602 | 92 |
| 2637. | TGGAGAGAAGAGTAGGGTCCGAGT[C,G]CAAGCCGTCCCTTCTTCACCCAGGA | 931,940 | 92 |
| 2638. | CTAGCTCATGCATGTGGTGGGCCT[C,A]CTTATTTATACCAGTTCCCACGCAA | 932,777 | 92 |
| 2639. | AAGATAATGACCACATGGACCAAA[A,C]TCCTTATATTGAGTCTGTGTGATGC | 932,957 | 92 |
| 2640. | AGATCCGATCAAATCCAAAAAaTA[A,G]GATTTGATCGGATTTGGGTAAAACC | 934,143 | 92 |
| 2641. | CCAAAAACTGTAGTACGGGTATAG[G,A]TAGGATATGAGTAGTGCTATTTTCT | 934,192 | 92 |
| 2642. | CCTGATCCGAACCTACGGATATGG[G,A]TAATATCCGAATCCATATCCAAATA | 934,261 | 92 |
| 2643. | ATCCAAATATATATGTTTATAATT[T,C]TATTTTGGTAATTCTATTTTGATTG | 934,302 | 92 |
| 2644. | ATATATGTTTATAATTTTATTTTG[G,A]TAATTCTATTTTGATTGATAATATG | 934,310 | 92 |
| 2645. | CTCTTTTCTTATCCGATCAGATAT[A,G]AGGTAGAATTTGGGTATAGAGTATT | 934,607 | 92 |
| 2646. | TATCCGATCCAAACCCTATCCGTT[G,C]CCATCCTTACTCCTCATTGACCCAT | 934,686 | 92 |
| 2647. | TTACTCCTCATTGACCCATTGTGA[G,A]GACCTATATCGATATGTATTTAGTC | 934,717 | 92 |
| 2648. | AATTATTTGATAGGAAGATCTAGG[T,A]TACTTATACAGAACTGAATAATCTA | 934,774 | 92 |
| 2649. | TTGGATAAGATCCTGGATTATTAT[T,A]AATAGAATCAAAGGGATCCGGCTCA | 934,484 | 92 |
| 2650. | GGCTCATAAGTCATCTGGAATGGG[A,T]GATATTATAGCACGGATTCATTGAG | 934,892 | 92 |
| 2651. | GGGGTGGAACCAAGCCGGGCGCTA[C,T]CCCTATCCAAGCCTAGTTCAAAAAT | 934,983 | 92 |
| 2652. | GGTGGAACCAAGCCGGGCGCTACC[C,T]CTATCCAAGCCTAGTTCAAAAATAA | 934,985 | 92 |
| 2653. | CGGGCGCTACCCCTATCCAAGCCT[A,G]GTTCAAAAATAATTTTCAGGCTTCA | 934,998 | 92 |
| 2654. | ATGTGTAAAAATCCAGGCCCGAGC[A,C]CAGGTTCGAATCCATTTGGGTTAGC | 935,069 | 92 |
| 2655. | TTGGGTTAGCTCGAGACATTACTT[A,G]GTTCAAGCCTAGCTCGAGCTCAACC | 935,109 | 92 |
| 2656. | GACATTACTTAGTTCAAGCCTAGC[T,C]CGAGCTCAACCCAATATTAATATAA | 935,123 | 92 |
| 2657. | GTTGGACGAGGCCTCAGGCCACTC[T,C]TTCTGCTACATGTGCTCTGCCATAC | 935,378 | 92 |
| 2658. | TCCCCCTCTCAATCTATGATGCCC[C,A]GTTGTTGTCGCCGCCTAGTCATAGG | 935,518 | 92 |
| 2659. | TTAATAGAGATTTGTTCCTCTTCG[G,A]GCCGATTAAGTAGTGTGCGCTCTGG | 935,648 | 92 |
| 2660. | CTTCGGGCCGATTAAGTAGTGTGC[G,A]CTCTGGAGCCTATTCGATGCCGTAC | 935,667 | 92 |
| 2661. | GCCTATTCGATGCCGTACCTTTCT[T,C]TAGCATGCTCATGAAGAAGAAGAGC | 935,699 | 92 |
| 2662. | GCCTCTCGGAGAAAAACCGCCACC[T,C]TAGATGTTCCCCCTCTGGAGCTTCA | 935,795 | 92 |
| 2663. | CCCCCTCCAGAAGAAACAAAGAAG[A,G]GAAGAAGAATGTGCGAACAGCGGTG | 935,874 | 92 |
| 2664. | GTGCGAACAGCGGTGCTGCAATTG[A,G]AAAATTAAATGAGAAGATTGGAATC | 935,909 | 92 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 2665. | TAGGATCGCACTTGCAGTCGAGCT[T,C]AGGTTGGGGCAATGGTAGGCCCGAG | 936,071 | 92 |
| 2666. | AACCTACAGTCGAGCCTATCCGAG[T,C]ACATTTTCAGCCTCACATGCGGGTG | 936,191 | 92 |
| 2667. | ACATCAGTTATTTGCTGGAAAGAT[T,C]TTAAATATTTATATAGAATCGAGAA | 936,254 | 92 |
| 2668. | CTGGAAAGATTTTAAATATTTATA[T,C]AGAATCGAGAAATTCAAATAATATC | 936,268 | 92 |
| 2669. | GAAAGATTTTAAATATTTATATAG[A,G]ATCGAGAAATTCAAATAATATCTTG | 936,271 | 92 |
| 2670. | AATATTTATATAGAATCGAGAAAT[T,C]CAAATAATATCTTGTGACTAATCTT | 936,282 | 92 |
| 2671. | ATTCTATAGCCAATCAATAATAAA[T,C]TGTTTGGCATCATTGTTCTTATGTT | 936,403 | 92 |
| 2672. | ATTGTTTGGCATCATTGTTCTTAT[G,T]TTTTTTtCTTTCAACAAATTAATCA | 936,426 | 92 |
| 2673. | TTGGAAGCTCAAAAATTTTACAAA[C,T]AATTTCAAGAAAAAaGAAAGGTTCC | 936,531 | 92 |
| 2674. | GAATCAACACACTAGCTGCCTAAG[C,T]TGAGCTGACTGTCCAAAATGAAAaT | 939,585 | 92 |
| 2675. | GATGGTTTACATAGACTGGATGCA[G,A]TACAGCAAATATCATCCATTAACTT | 939,800 | 92 |
| 2676. | TCATACTGGTTAAAATAGGCTGAT[A,G]TCTAGAATATCATTGAACCTTAGCC | 939,857 | 92 |
| 2677. | AAATAGGCTGATATCTAGAATATC[A,G]TTGAACCTTAGCCAGGCAATGTTCC | 939,869 | 92 |
| 2678. | AAGCTCATTTGCAAATTTACTTCA[T,C]GATTTTTTGATGGATTGATAATAGT | 940,532 | 92 |
| 2679. | TAATAGTTTGCCATAAATCTTTCA[G,A]AGTTTCATATAAATTGGCAACTACA | 940,575 | 92 |
| 2680. | ATCTTTCAGAGTTTCATATAAATT[G,T]GCAACTACAGACAAATTAATGCACT | 940,591 | 92 |
| 2681. | TCAAAATGCTTGCGGCAGAAGAAC[G,T]GAAAGACGTCTTTGGGTGGGTTTGG | 941,002 | 92 |
| 2682. | GTTTTGAACCTAATGGAACAGGAC[T,A]AACCTGAAAAATAAGCCCATTTATT | 941,058 | 92 |
| 2683. | CCATTTATTAAAAGGATAGGTCTC[G,A]GCTTGGGGATTAAAGCTTGGCCCAG | 941,099 | 92 |
| 2684. | TGAACCACGAAAAGCCTGCTAGAC[A,G]TTTCCATTTCTTTTAAAAAAaTAGC | 942,823 | 92 |
| 2685. | CAATATAACAACTTTTCGGCTATA[A,G]AGCTGAACAAAATCACCACTTTTTC | 943,047 | 92 |
| 2686. | CGATACGTGACTGTAAAGGCAAAA[A,G]AAAAaGGTATCACAAAGAATATATA | 943,695 | 92 |
| 2687. | TTTCCATCATCACTAACAACCTAT[A,T]AAATGCAAAAGGCATGGTGTATCAG | 943,839 | 92 |
| 2688. | AATGTATCAGTGACAGTAGTGCCA[G,C]CAACTAGCAAACTGCTGTAGAACTT | 943,919 | 92 |
| 2689. | ACTTTTCTATATGAAAGTTACAAG[G,A]GATTTTGAATGAGGAACAAAATGCA | 943,965 | 92 |
| 2690. | CAACATGCAACCAGTTATGGAAAG[C,A]AGTTGTTGGGAAGGCATATGATCAA | 944,013 | 92 |
| 2691. | ttAAGAAAATAGAGGGGATGAGTG[G,T]CCCCCTAATTGCTCTGACCATTATA | 944,428 | 92 |
| 2692. | AAaGAAAACTCCACCTCCACCTAC[C,A]AAAGCCAGTTTACACCTAATCCATT | 945,112 | 92 |
| 2693. | TGTTGAATGTAGCGGATCACTAAG[T,C]GTAGTCACATTGCAATGGATCGTCA | 945,311 | 92 |
| 2694. | GCTTATGAGTCAACAGTCTTGTAA[C,T]GCAATGACATGTACATAACATCTTG | 945,541 | 92 |
| 2695. | TCTCAAATCTCTCATCTCCCATCT[T,C]TCTTTTtCTTATCCCTAAAGTTCCA | 951,947 | 92 |
| 2696. | CATCCTTCTTTGCTCGGTTCTtCT[T,C]CTCCACTCGTCTCCCATCATCTCCT | 952,043 | 92 |
| 2697. | CCAACACCTCTCACTAAGCCAGCA[C,T]CAATTTCATTGTCTTCTCCTCCCAT | 952,094 | 92 |
| 2698. | AAGAAGAGAAACTGAAAGATAATC[A,G]GAGAAGAAAAAaGAAAAaTAAGATT | 952,193 | 92 |
| 2699. | ATCAATGGTTGTCACATCAGACTT[T,C]CAATGAAAGAAAGCCATCAGAATAG | 952,318 | 92 |
| 2700. | TCAAGGACTAAACTTTAGCTTTTT[A,G]TAATTTAGAGATTTTTTAAGAATAT | 952,403 | 92 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 2701. | TGATGATTGGAAGGCTTAAATTTG[G,A]CCACTTGTTTATTTATATAAGCGGT | 952,637 | 92 |
| 2702. | GGCTCAACCTAATTTTGCATGAAT[G,A]TTGAAGAACTCATTGTTTGTGGGTT | 952,967 | 92 |
| 2703. | AGTTTAAGTGACTTGTGAATTTGG[T,C]CGTGGACTAAAATGATTCGAGTCTC | 953,104 | 92 |
| 2704. | ACTCCTTTTATATGGGATCAAGTA[G,A]TAGAATTGGCCATGTTTGGAGCAGC | 953,178 | 92 |
| 2705. | TGGAAGAATTGATTCTATTTCTGT[A,G]ACGCATAAGTAGTTCTGCTCAATGT | 953,966 | 92 |
| 2706. | GTTCTGCTCAATGTGCATCACATC[C,T]AAGTATATATCACAAGTATATGGAT | 954,002 | 92 |
| 2707. | AACTAATTGACCCAAAGTTTAACA[A,G]GTAGTACTCTTCAACAATCTATTAA | 954,469 | 92 |
| 2708. | GTGCCTAACATCTTATAAATTTTC[C,A]ATCATGATAATTGTTTATTTTGGTA | 954,540 | 92 |
| 2709. | GTAAAGTACTTATGTATATACACA[T,C]ATAAAATATACAACAAGAGTTGCAT | 954,724 | 92 |
| 2710. | GGCTGTGTCCAAGTAATTTCGATG[T,C]AGCCGTCAGCAAAGTCCAATTTACC | 957,113 | 92 |
| 2711. | AATTTCGATGTAGCCGTCAGCAAA[G,C]TCCAATTTACCTTAGATTGATGGCT | 957,127 | 92 |
| 2712. | GGCCCAAATCTTATAAAATATGAG[G,A]AGGCATTTTTAAACCAAATCCGTTG | 957,431 | 92 |
| 2713. | AAATCCGTTGAAAAATCCAAACAT[A,G]CCCTTGAGAACATGTTTGGATATCT | 957,471 | 92 |
| 2714. | TTCCTTTAAGAAAATAAGAAACCA[T,C]AATAGTAAACAGAAGAAAACTGACA | 957,685 | 92 |
| 2715. | TCCTTTAAGAAAATAAGAAACCAT[A,G]ATAGTAAACAGAAGAAAACTGACAT | 957,686 | 92 |
| 2716. | TGATAGGTTGTAGAATAGATGATG[C,T]AGCTATACAATCATGGCAAAAGGCT | 958,371 | 92 |
| 2717. | GCGAGGAGGAGGGCAGTAAGATAT[A,G]GACAGCGTGGGAGGAGGTGGCGAGA | 958,777 | 92 |
| 2718. | AGGTGGCGAGAGGGTAGAGAAGTG[A,G]GAGGAGGAGGAGGGAGAGGGTGCGC | 958,816 | 92 |
| 2719. | ATCCTATTCTTCCCAAACTGGCTC[C,T]AAAAAGCTCAAAAGGCTTGGCCTGC | 959,110 | 92 |
| 2720. | CTCTACTAGTGTAATATAATAATG[C,T]GAAGATCATGCTAATATAGGATAAT | 960,098 | 92 |
| 2721. | TGTGTAAATGCTGTTTTGCAGGTG[C,G]TCGTTACCGATGACAGAGGACGGGG | 965,263 | 92 |
| 2722. | TAAATAGCGGACGACTTGAGCTGA[T,C]GGTATGACAAAATTATCAACCGACG | 965,339 | 92 |
| 2723. | CTGCTCAACATGCCATACCGTCAC[G,A]AATGGTTATCGACCGCATATCACGG | 965,422 | 92 |
| 2724. | CCACTTTTGATCAGAGCTCTGCTA[C,T]ACTGAATATTCAACAACTACTGTTC | 965,605 | 92 |
| 2725. | AACAACTACTGTTCACCAACTTTT[C,T]TCTCTGACTTAAGCATCGAAGGATC | 965,641 | 92 |
| 2726. | CTTTTCTCTCTGACTTAAGCATCG[A,G]AGGATCCCCGCCGGACACCATTCCG | 965,660 | 92 |
| 2727. | ATGCTGTTTTGCGGGTGCTCGTTA[C,G]CGGCGACAGGCGACGGAGAGTTGGC | 965,720 | 92 |
| 2728. | ATAAGGAGAAAAAaTTCTTCCCA[C,T]ATGAGGTACCTTTTAAAGGACAAAA | 965,969 | 92 |
| 2729. | GTGGACAATACCTCACATGACGGA[T,C]CGAGCCTTTGTCCGCAACAATGGCG | 966,040 | 92 |
| 2730. | CCGCAACAATGGCGCGCCACATTG[A,G]TTGTGAGTCAAGAGAGACTCGCACT | 966,076 | 92 |
| 2731. | ATAGATTCCAAACAGAACCATAAT[A,G]TGACCTTATCACATTAACTTGGGTT | 966,408 | 92 |
| 2732. | CCTTATCACATTAACTTGGGTTTA[C,T]AGTGGAAGAGAATGGAGAGATGGTG | 966,436 | 92 |
| 2733. | AAGAGAATGGAGAGATGGTGAATA[C,T]ACTTCTATCAGAGCAAGGAATAAAT | 966,466 | 92 |
| 2734. | TTATATCCCAATGATATGATATGG[G,A]AATAATGTGCAGGAATAATGGTAGG | 966,551 | 92 |
| 2735. | ATGATATGATATGGGAATAATGTG[C,T]AGGAATAATGGTAGGCATATAAAAA | 966,561 | 92 |
| 2736. | AAGCATTGAAAAAAaTAGTAAAAT[A,G]GAATAAGCAAGCATCGCATATCACA | 966,658 | 92 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 2737. | GAAACACAAGAATTTATATCAGTA[T,C]AGTATAAAGTTCAACCAATGATATA | 966,713 | 92 |
| 2738. | GATATATGGGCATATTTAACCAAG[A,G]TTTCTTGTACCGGTACCGGTGGCCG | 966,757 | 92 |
| 2739. | AAATCCTAGAATTCCAAGTTCTGT[A,T]TTCTTGTCCGAACACATTCATGCTC | 968,452 | 92 |
| 2740. | GTCAGAGAATATATCAATGCTCAC[T,C]TGTCAAGAACACAAATAATGGTATT | 968,541 | 92 |
| 2741. | TTCACAACCTCTTTCACGAAGCCC[T,C]CTTCTTCCCCTTCAGCGAACTCCAC | 968,610 | 92 |
| 2742. | CTCTTTCACGAAGCCCTCTTCTTC[C,T]CCTTCAGCGAACTCCACCTGAACCA | 968,618 | 92 |
| 2743. | GACCAGCCAAATGAACGTGACTCC[G,A]GCGACGAAGAATGGGTTCCGGTTGA | 968,834 | 92 |
| 2744. | GGAGAGGAATCATGAGGCAAGACG[A,C]GAGGGAAAGAAAGAGAAAATGCGGA | 969,259 | 92 |
| 2745. | TGGGAGGAATTTCTCCAGGTTTTA[C,G]AGTTTGAATCACCAGTAAAACATGA | 969,734 | 92 |
| 2746. | AACGGTCACTAGGATCTGGTTGTT[A,G]TAGACCCCTTATCCTCTCCCACTTC | 969,931 | 92 |
| 2747. | TCTAGTCTTATGGTGAAGGGCAGG[C,A]AGAAAATGTTAGTGCTAGCTTTGTC | 970,020 | 92 |
| 2748. | GAAAATGTTAGTGCTAGCTTTGTC[C,A]ACGAGAGATCATCAAGGAAGAGCCAT | 970,046 | 92 |
| 2749. | TCATCAAGGAAGAGCCATTCTCAG[G,A]GCTGGTCAACTTCGGGGAGCTTGGG | 970,078 | 92 |
| 2750. | AACTTCGGGGAGCTTGGGAAGGTG[C,T]AAGTGCATTCTTTCATTTGGATCAT | 970,110 | 92 |
| 2751. | TTAGGTCAATGGTGCAAAATAAAA[A,G]CTAAAGGTGATGAAAAGCTGACTTC | 972,260 | 92 |
| 2752. | ATGTGTAACAATCGATACTTCAAA[G,T]GTGTCAGAATTTTGGACCATCCAAT | 972,375 | 92 |
| 2753. | AACAATCGATACTTCAAAGGTGTC[A,G]GAATTTTGGACCATCCAATAGCTGA | 972,381 | 92 |
| 2754. | AATGATTCAAACTTGTAGTATTTG[T,C]CAATTGCAAAAGATCACCCTGGTT | 972,486 | 92 |
| 2755. | TGATTCAAACTTGTAGTATTTGTC[A,G]ATTGCAAAAGATCACCCTGGTTAG | 972,488 | 92 |
| 2756. | AAAAGATCACCCTGGTTAGACATG[C,G]TTAGTTTAATCATGCCTTCATTCAA | 972,519 | 92 |
| 2757. | TGCCTTCATTCAACACTAGGGCAG[T,C]GAGCAAAGTATGTGATTGCTCACAT | 972,556 | 92 |
| 2758. | CATGAGAATCATTGCTGATTGTCC[T,C]GTATTTCAAATTGTCATCCAACTTT | 972,711 | 92 |
| 2759. | ACCAAAACAGAGTAACCTTTTGAC[G,T]TGCACACAGTCAATAGAAGGTTTGT | 973,334 | 92 |
| 2760. | CAAAAGAATCTGCAGTAAATTGCA[T,C]GGCAATGAGGAAGACCACTGGCAT | 974,479 | 92 |
| 2761. | CCAGAAATGTGAAATAATTTGCAT[T,C]TGGCAATGAGGAAGACCACTGGCAT | 974,626 | 92 |
| 2762. | AAGAGAAGCTTCATGTATATGTCAT[C,T]ATTCATCTCAATTGTACATTCTGA | 974,729 | 92 |
| 2763. | AACTAATTTAGGTAAATAGTTTGG[G,C]TGTTTGAGTATCAAGTGAGAAATAA | 975,411 | 92 |
| 2764. | TCATTCATAGGGCAGTATGCTGTT[A,T]ACAGCTTATTACATAGACAGTCTGC | 975,509 | 92 |
| 2765. | GAAATAGAATCCATGATTAAAAAT[C,T]AAATTTAAGAACTTGTCGAATTGCT | 1,030,909 | 92 |
| 2766. | GTTAGATGCCATGAAAGATGAAAT[A,G]GAATCCATGATTAAAAATCAAATTT | 1,030,928 | 92 |
| 2767. | GATATTGAGATAAAAGATGATCCA[A,G]TCTCATTTAAGGATACTTTGAATAG | 1,030,996 | 92 |
| 2768. | AACAGACTATCAATGAGCTTGATC[C,T]GATTAAAAATAATCATAATAATGAT | 1,031,136 | 92 |
| 2769. | TGAACCGTATAATATGGTGTTACA[A,G]AAAaTAAAAAAaTCTCTTCCTATTA | 1,031,270 | 92 |
| 2770. | TAGGTTCATTGAGGATGGTGAAAA[T,C]AGTGGAAGTAGTGAACCGTATAATA | 1,031,306 | 92 |
| 2771. | GAAAATCGCTATGTATATCTTAAA[T,C]CGGATACTTAGTAAGGTCGTTTCTA | 1,031,568 | 92 |
| 2772. | ACAGCATAGCATTGTAACACAGTA[C,T]ACTATGTCAGAAAATCTCCAACAAA | 1,031,686 | 92 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 2773. | AAAATCAATTAGATAGAAAAATTA[T,C]GATTATGAGATCTGATAGGGATGGT | 1,031,798 | 92 |
| 2774. | CTCGCATTGTGGTTATATTTTTCT[A,G]TTGCATGAAAAATTTGAAGCTTTGA | 1,031,878 | 92 |
| 2775. | GATACATACCGATATTTGTGGCTA[T,C]TTTATATCTTATTTTGGAGTGGCAA | 1,031,957 | 92 |
| 2776. | AAaTAAaTTAAAAGATATAAAAAG[C,T]ATGCCACTAGAAGTCAAAAATTCTT | 1,032,013 | 92 |
| 2777. | AAAaTAAaTTAAAAGATATAAAAA[G,A]CATGCCACTAGAAGTCAAAAATTCT | 1,032,014 | 92 |
| 2778. | TAAATTAATAAAAAAAaTTATTTT[A,G]GTTGTTATAGGAATATTGTGCAATA | 1,032,285 | 92 |
| 2779. | CAGTTGGGACCTACAGATTTATTA[T,C]AGATATTGGATTCCAATTAGATCTA | 1,032,432 | 92 |
| 2780. | GCTGCTATTCATGTTTACAACTCA[A,T]TACAGGGATTCCTTTCAAGTCGAAA | 1,032,541 | 92 |
| 2781. | GAAAAGAAGGATATTCTCTTATCA[T,C]TTATTTGTTTCAAAATTAATTTTAT | 1,032,628 | 92 |
| 2782. | ATTAAAATATTTTTTCTATAACAA[G,A]GAGGGACATATCAAGAAGGATTGTA | 1,032,698 | 92 |
| 2783. | CTCATAAATTAAAATATTTTTTCT[A,G]TAACAAGGAGGGACATATCAAGAAG | 1,032,705 | 92 |
| 2784. | AGATTGAAACATGAAGGGGTCCCA[A,G]TTATTCATGTGGTTTCACAGGAGCA | 1,032,817 | 92 |
| 2785. | ATCTCCTAGTGTGTGCAAGAGGAA[A,G]AAAGATTGAAACATGAAGGGGTCCC | 1,032,844 | 92 |
| 2786. | AATAGTTTATCAGATCAAGTAAAG[T,C]CTTAGCTGGTATCTTAATGAACAAG | 1,033,102 | 92 |
| 2787. | AGTTTCACAGCGAGAGATATTAGG[A,G]GATCTGTTTCTGATAACGAATTGGC | 1,033,178 | 92 |
| 2788. | CTTTCATGATTATTAAGAGTTTCA[C,T]AGCGAGAGATATTAGGAGATCTGTT | 1,033,195 | 92 |
| 2789. | GAGCATTCTAATAGATTATCTTTC[A,G]TGATTATTAAGAGTTTCACAGCGAG | 1,033,214 | 92 |
| 2790. | CTTTTACTTATAGTTATGACCCCC[A,G]TTTTACTCTCATCGCATTTTATCTAA | 1,033,394 | 92 |
| 2791. | CATCATGATCGTAATTATGAGCAT[A,G]TTCTTTTACTTATAGTTATGACCCC | 1,033,421 | 92 |
| 2792. | ATGTTTTATAGTTGTATAATAAGT[G,A]TTATTAGCAGAATTGTGTTAGAAAA | 1,033,475 | 92 |
| 2793. | GAATATATAACTAATATGATGGAT[C,T]ATAGTTTAAATATGAATTATATGTA | 1,033,673 | 92 |
| 2794. | AATTACATAAAGATGGAGAATTCT[A,G]CATTCAAAGATGGGAATAACCTAGA | 1,033,753 | 92 |
| 2795. | GACCCAAAGGTTACTGTAATTTGA[T,G]ACAAAATTAATAGCAATAGGTTAGC | 1,033,810 | 92 |
| 2796. | GTCATTGAGGGCTGATGATTTTTT[C,T]TCTCATTATAGTTTTAAAATTACAT | 1,033,881 | 92 |
| 2797. | TATTGTAATATTCAAGTGTATTTT[T,C]GCATAGCCCCAAAGGGCTCGGAGCA | 1,033,954 | 92 |
| 2798. | TATTTGATAATTTTGCTCATTATT[G,A]TAATATTCAAGTGTATTTTTGCATA | 1,033,974 | 92 |
| 2799. | CCGATTTGAGCATTTTTTtGAACC[G,A]TTGGACTCATGATGGCTTGAAGAAT | 1,034,077 | 92 |
| 2800. | GAAATAATTATCTTATAGAAAAGT[C,T]CCTTTTTTGTCTGAGATTTACGATT | 1,034,183 | 92 |
| 2801. | TGACATAGTTTATTACAGAAAAAT[C,T]CCTGAAGTTTTCTGACAGACTTATT | 1,034,235 | 92 |
| 2802. | CCCTGACATAGTTTATTACAGAAA[A,G]ATCCCTGAAGTTTTCTGACAGACTT | 1,034,238 | 92 |
| 2803. | TAAAATTATTTTGCAAATAAACCC[C,T]TGACATAGTTTATTACAGAAAAATC | 1,034,260 | 92 |
| 2804. | CGAACCCATAATAGCCTTTCGGGT[C,T]TTAGGTTTGATCCATTAAGGTTTCA | 1,034,344 | 92 |
| 2805. | GCTTCTTGTCTTCAGTGGCTGGGG[T,G]GGATAGGGGCGGCGCTCGACCGCTC | 1,034,489 | 92 |
| 2806. | CGCGGTGTCTCCGTGTGGCTATGA[A,G]AAATCATGGCTTCTACCATGGCGAT | 1,034,587 | 92 |
| 2807. | CGGCAGTGGGAGCCACCACCGCAC[G,A]CGGTGTCTCCGTGTGGCTATGAAAA | 1,034,610 | 92 |
| 2808. | GGGTCGCCGGCGGAGGGGGAGCTC[C,T]TGCTCCCCGACGGCAGTGGGAGCA | 1,034,645 | 92 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 2809. | TTAAAATTATTTTTTt[C,T]AAAATAAAATAAGATTTAAAAAaTT | 1,034,827 | 92 |
| 2810. | TTGCATAAATATCAGAGTACGATC[T,C]AGATATAAAGGAATTAAATTATCTA | 1,034,947 | 92 |
| 2811. | AATCATCATATTGGCAAGATGACG[A,G]CGGAAGGTATAGTTTACTTATGATT | 1,035,004 | 92 |
| 2812. | AACTCTTTGGATCAGCCATATATC[A,C]TGAATCAATTATAGTAAGCCTAAT | 1,035,288 | 92 |
| 2813. | ATTCATAATATGATCTAATTATCA[A,T]TTAATCAGATTTAACTCTTTGGATC | 1,035,325 | 92 |
| 2814. | TGATTCATAATATGATCTAATTAT[C,T]AATTAATCAGATTTAACTCTTTGGA | 1,035,327 | 92 |
| 2815. | GGATATAAAAATATTGGATTTGA[T,C]TCATAATATGATCTAATTATCAATT | 1,035,348 | 92 |
| 2816. | CTATCTTGCTTCTTTTTCCTTGTC[C,T]GATGGATTCTACACAAGCCTTTATA | 1,035,475 | 92 |
| 2817. | ACAAGTTAATGAGAATTATTTTTT[G,A]TGTACTATCTTGCTTCTTTTTCCTT | 1,035,504 | 92 |
| 2818. | TAGAACCTGATAAATGTGTCTCTT[G,A]ACTTTCTCAAGATGATATTTAGAAT | 1035,821 | 92 |
| 2819. | ACAAGAGATTATGCGAAAGAATAT[G,A]ACTTTCTACTGAAAGAGAGAGGAAA | 1,036,020 | 92 |
| 2820. | TAGAAAGAATACAAGAGATTATGC[G,A]AAAGAATATGACTTTCTACTGAAAG | 1,036,030 | 92 |
| 2821. | TTCCACCAAGTCCTAGAGATCTTG[T,C]GATATGAAGAGCATCCTCATTTGGA | 1,036,262 | 92 |
| 2822. | CTTGATTCTATGCCCCGAAAGCTT[C,T]TGGAGTACTTGCTGGTTCTTCATAG | 1,036,317 | 92 |
| 2823. | CTGGATGAAGAGTAAGGCCTTCGC[A,T]TTCTTCTTTTTGCACTCCCTATACT | 1,036,379 | 92 |
| 2824. | TATTCTATCGGAGCCTTGAAAATC[C,T]TTTTTTtAAATTTTtCATGCATCTT | 1,036,481 | 92 |
| 2825. | TCCCTCCACAAAGATTGAAGCTTG[A,C]TACAAGTTATTCTATCGGAGCCTTG | 1,036,513 | 92 |
| 2826. | AGCTGGCAACTCTTAAAATTTTTT[A,G]GACAATTTTGCATTCTGGAATAATA | 1,036,656 | 92 |
| 2827. | CAAATTTAGCTGGCAACTCTTAAA[A,T]TTTTTTAGACAATTTTGCATTCTGG | 1,036,663 | 92 |
| 2828. | CCCATTAGTTCATGCAAGGGAGAAA[A,G]GAGATAAATCCTTTGATTCTTCAAT | 1,036,730 | 92 |
| 2829. | GAGGCGAACCTGTTCATTCTTTCC[T,C]CATGTGCTTTAAGAGAGCCCATTAG | 1,036,772 | 92 |
| 2830. | CTGTTTATGCCTATCTTTTTGCCT[T,G]GAGCTTCCAAAAAATTTGGCTTCCA | 1,036,929 | 92 |
| 2831. | TTCTTGCAAATAAAACATTAAGAT[A,G]AGGAATTACCATTTCTTGGGTTACT | 1,036,977 | 92 |
| 2832. | CATTTAAAATGATAATTTCTTGAT[T,C]CATGCCCAAACTTCTTGCAAATAAA | 1,037,013 | 92 |
| 2833. | ATTCTTTATACTAACAATCCCTCT[C,G]AGAAAGATTTGGAATTTTGCATCTT | 1,037,066 | 92 |
| 2834. | ATTTGCTTCATTAGGTTGCCTTTT[A,G]TTCTTTATACTAACAATCCCTCTCA | 1,037,090 | 92 |
| 2835. | CCACACCTCTGCCTTCAACTTATT[A,G]TAGTTTGCCATCTCTAAGCTTGATT | 1,037,292 | 92 |
| 2836. | TGAAGTCATTTTGATCTTAGCAAT[A,G]ACAATATCTTTCTTCTTATCAAGAA | 1,037,483 | 92 |
| 2837. | AAATCTTGTTTGAAGTCATTTTGA[T,A]CTTAGCAATAACAATATCTTTCTTC | 1,037,493 | 92 |
| 2838. | TTCAAGCCTTTATAGTTGAGCTGA[T,C]CATATCTCAAATGCCATAAGTAAGA | 1,037,602 | 92 |
| 2839. | CAACTTCAAAGCCTTTATAGTTGAG[C,T]TGATCATATCTCAAATGCCATAAGT | 1,037,606 | 92 |
| 2840. | GAAGCCCAATTACCATATTTTTAT[T,C]TTTCAACAACTTCAAGCCTTTATAG | 1,037,637 | 92 |
| 2841. | CCAAGCCCTCTTGGAAATGGAAGC[C,T]GATGCAGTTTTCCATAAACACAACC | 1,037,719 | 92 |
| 2842. | TCCAAGCCCTCTTGGAAATGGAAG[C,T]CGATGCAGTTTTCCATAAACACAAC | 1,037,720 | 92 |
| 2843. | GGCCTCCAAGCCCTCTTGGAAATG[G,A]AAGCCGATGCAGTTTTCCATAAACA | 1,037,724 | 92 |
| 2844. | TGGCCTCCAAGCCCTCTTGGAAAT[G,A]GAAGCCGATGCAGTTTTCCATAAAC | 1,037,725 | 92 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 2845. | GCACTAGCTCTAGCGGAGCTTGTG[G,C]CCTCCAAGCCCTCTTGGAAATGGAA | 1,037,747 | 92 |
| 2846. | TCAACGTGCACTAGCTCTAGCGGA[G,C]CTTGTGGCCTCCAAGCCCTCTTGGA | 1,037,754 | 92 |
| 2847. | ACATCTTCTTGGTATAATCATCAA[C,T]AAAGAGAAGAAAAAATCTTTTTTGA | 1,037,837 | 92 |
| 2848. | TTGAACTGGAAGAAGAAAGAGAAT[G,A]CCTCTGACTTTTGCTCAAGAAAGAA | 1,037,892 | 92 |
| 2849. | GCTCTACAAAAGCTTTGAACTGGA[A,G]GAAGAAAGAGAATGCCTCTGACTTT | 1,037,906 | 92 |
| 2850. | TTTGATGATTGCTTTGCCGCTCTA[C,T]AAAAGCTTTGAACTGGAAGAAGAAA | 1,037,924 | 92 |
| 2851. | GTAGTTCATGAAGGTTCCAAAGGT[G,A]AATTCTCCTCCACGATCTATTCTTA | 1,037,983 | 92 |
| 2852. | GCAACTCCATTTTATTCTGGTGTG[C,T]AGCGGATAGTGAGTTGTCTCTCGAT | 1,038,048 | 92 |
| 2853. | GGCAAGCCTTTGCATTCATCATGC[A,T]TCTAGCCATCTCTACAATTGTGAA | 1,038,110 | 92 |
| 2854. | AAAAATTATTTGGCAAGCCTTTGC[A,C]TTCATCATGCATCTAGCCATCTCTA | 1,038,121 | 92 |
| 2855. | TGCCAAGCTTCATAAGGAGTTTTG[T,C]TCAGCATTGCTTTTGTTGGAGATCT | 1,038,209 | 92 |
| 2856. | ATGCCAAGCTTCATAAGGAGTTTT[G,A]TTCAGCATTGCTTTTGTTGGAGATC | 1,038,210 | 92 |
| 2857. | CAAAGACTTTAAGATGATTTACCT[C,G]AGGCTTTTGCCTATGCCAAGCTTCA | 1,038,247 | 92 |
| 2858. | AGTCAAAGACTTTAAGATGATTTA[C,T]CTCAGGCTTTTGCCTATGCCCAAGCT | 1,038,250 | 92 |
| 2859. | TGATCAAATTTATCTCTATTTTGA[G,A]ATGGAATAAGAGAATAAGCTATGCA | 1,038,299 | 92 |
| 2860. | TACAAGTTCATCAAAGAATACATC[T,A]CGAGAAACAATAAGTTGATTTTTTG | 1,038,417 | 92 |
| 2861. | CCCATTATTATGCTACAAGTTCAT[C,T]AAAGAATACATCTCGAGAAACAATA | 1,038,430 | 92 |
| 2862. | GATGATTTGACTTGAAATGTCTTC[C,T]CTTAATGCTCTCATTGGGCTTGGTT | 1,038,555 | 92 |
| 2863. | TGTAAGCTGCACACCTTTTTTGGG[A,G]TGAAATAGAATCTGTGATGATTTGA | 1,038,595 | 92 |
| 2864. | GTGGTTCACATGAAAAGAAGGCAA[C,T]ATTACAAGATTCATAGATCTCATGT | 1,038,642 | 92 |
| 2865. | TCTTCATCTATGGATTTTAGCCAA[A,T]TCTCATCTTTTCTTGCTTTTTAAA | 1,038,697 | 92 |
| 2866. | AGAGATCAAGAAGCTCCCATGTGC[A,C]ATTTCTTTCGATAGTGATTATTTCT | 1,038,744 | 92 |
| 2867. | CTTTGTGCTTATCGATTGAGTCAT[T,C]TTTtTGAACTTTGTCTTATAGATC | 1,038,825 | 92 |
| 2868. | GCAACAGCAAGAACCATTCTCACT[A,G]TTTCTATACGAACAATAGATGCAAA | 1,038,931 | 92 |
| 2869. | TCATTTGAATTGCAACAGCAAGAA[C,T]CATTCTCACTATTTCTATACGAACA | 1,038,942 | 92 |
| 2870. | TTGCTTTAGGCCATATAATGCCTT[C,T]CGAAGCCGATACATCTTATTTTCTT | 1,039,094 | 92 |
| 2871. | TAGTGAAAATAGCCATCAATTCTG[G,A]TGTTCCATGCATGCGGAGCTTGCTT | 1,039,138 | 92 |
| 2872. | TCAAATCATCAACATATAAGCAAA[A,G]GATTAAGAAATCCTTACCTTGCAAT | 1,039,233 | 92 |
| 2873. | TTCTTCCATTATGATGTCGGTGTA[G,T]ATCAAATCATCAACATATAAGCAAA | 1,039,259 | 92 |
| 2874. | TAACTTGGATGCCAAGAAAATAAT[G,A]CATAAGTCCAAGATCAGTCATTTCA | 1,039,335 | 92 |
| 2875. | TTCTATTGTGATATGCAAATTTTT[T,C]CATTCGACTGAGTAACTTGGATGCC | 1,039,372 | 92 |
| 2876. | CAATTTCCCATATGAAACTTCTTG[A,T]GCAAATCTTCAATATACTTCTATTG | 1,039,414 | 92 |
| 2877. | TGAAATTTCTTATTTTTAGCCAAA[C,G,T]GACTGGCCATCGGCTTGCAATTTCC | 1,039,456 | 92 |
| 2878. | TGTATGTGTGACATAAATGAGTGA[A,G]CCAACTAAACTTCTATAAGTTGTGG | 1,039,535 | 92 |
| 2879. | TTTGCTTGGTTGAATCATAAATCT[G,A]GATAAGAGACTAATCGAAAAAATAA | 1,039,595 | 92 |
| 2880. | GTTCCTAGGCAAAATATGTAGCCT[A,G]ATGTACTTTTGCGATCATCAAAAGA | 1,039,768 | 92 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 2881. | ACATCAGTAGCTGAAATATATTCT[A,G]CTTCAGTAGATGAAAGTGCCACTAC | 1,039,852 | 92 |
| 2882. | GATATGCTTGGTCCTGTTATGAAA[C,T]ACAAGATTCTTTATCATAGCTATTG | 1,039,994 | 92 |
| 2883. | TGACAAACACTAGTTGAATATCTC[T,C]TTTCTCAACAAGTCTCTGATGAAAT | 1,040,057 | 92 |
| 2884. | AGATGACATTTGGAATTCCCAAGT[T,C]TCTTGAATTTCTTAAGACTATTAAT | 1,040,246 | 92 |
| 2885. | CAGAGTTACAATATGACTCTTAAT[G,A]TTCTAGAACCTGATAAATGTGTCTC | 1,040,308 | 92 |
| 2886. | CAACTCATGCTTCACATCATACCA[G,A]GGGCTCTATTGCCTCCTATTTATAG | 1,040,409 | 92 |
| 2887. | AGGGAAGATATCATAGGAAAGGCC[C,T]CAACTCATGCTTCACATCATACCAG | 1,040,434 | 92 |
| 2888. | GAGGGAAGATATCATAGGAAAGGC[C,T]CCAACTCATGCTTCACATCATACCA | 1,040,435 | 92 |
| 2889. | CATCATCACATACTTGTTGGGTGC[C,T]AGAAAGAATACAAGAGATTTATGCA | 1,040,513 | 92 |
| 2890. | ACACCAAGCCTCTTATTTATCAGG[G,A]TTGAATTCCTGCAAGCCATCAGGCT | 1,040,671 | 92 |
| 2891. | ATTTAaAAAAAAAaTCGATCATGG[T,A]GTATGGTAGAATATTTCAAAGTCTG | 1,040,740 | 92 |
| 2892. | AAAATAATATTTAaAAAAAAAaTC[G,A]ATCATGGTGTATGGTAGAATATTTC | 1,040,748 | 92 |
| 2893. | CTCAGCCCAAGTATTGTATTTTTG[G,A]AAATAAGATGAAAAGAGGGGTAGAT | 1,040,815 | 92 |
| 2894. | TATTCAAAATCGCATGTTCAATAT[G,A]TGGTTTCACCGTATCCGTGCAAACT | 1,040,863 | 92 |
| 2895. | GCACCCCACCTCACCACCCCCACC[A,G]TCCAGCCACCGCCCCCAGCCGCCCAG | 1,041,175 | 92 |
| 2896. | GCTTCATACCAAAGGGCAAGCAGG[A,G]GCTGCAGGTGTGGGCTTCTCCAAGA | 1,042,223 | 92 |
| 2897. | AAAATATCATTATTATTAGAAATA[G,A]AAATAGAAGGTATAATAATATTATT | 1,042,587 | 92 |
| 2898. | TATTTGATTAATAATAAAATATCA[T,C]TATTATTAGAAATAGAAATAGAAGG | 1,042,602 | 92 |
| 2899. | AGAAGGGAAGGGGGTGCTGGGCTA[C,T]AGGGGCAGTAGAGTGCAGCACGGGg | 1,043,225 | 92 |
| 2900. | TACCATAACAAAAAaTTTAAAaTT[T,A]AAAATTTATTTtAAATTTAAAACTA | 1,043,443 | 92 |
| 2901. | TTGATAGGGACACGACGAAACCAC[G,A]TATTGTGGTTTAATATGTGATTTCA | 1,043,524 | 92 |
| 2902. | ACTTGGAGTGAGTTGATAGGGACA[C,T]GACGAAACCACGTATTGTGGTTTAA | 1,043,536 | 92 |
| 2903. | GTGCTGGTTTACGAGCACGTCACC[A,T]TCAAGGCTCTACCGTGACGAACTT | 1,043,929 | 92 |
| 2904. | TGAAAAATCAATAATTAAGCAAAA[T,C]TTTTATATGAAGTCCATTTGATATA | 1,043,994 | 92 |
| 2905. | CTTAAATCAAAGAATAGAATCACT[T,A]GATGTCCCTTAAATGTCTATTATTT | 1,044,066 | 92 |
| 2906. | GCCTAATCATTATTTCTCCGTTGC[A,T]AGAGATGCGTCTCGGTGGCAGATGG | 1,044,569 | 92 |
| 2907. | AATTTATGAAAGATAATGACCCTT[T,G]TTCTTATTTTCTCTTTTTTACATA | 1,044,802 | 92 |
| 2908. | AAGCCTTGCTGATACAAAATTTGG[G,A]TTCAATTTATGAAAGATAATGACCC | 1,044,830 | 92 |
| 2909. | TGATTAAGTCCGGATTGTAACATG[T,G]GGACGACACATTTGTGAAGCCTTGC | 1,044,871 | 92 |
| 2910. | TTGAATCACAATTTAATAATAACT[A,C]CCGCTATGATTAAGTCCGGATTGTA | 1,044,902 | 92 |
| 2911. | AAGGTAGGTTGGCGATTAATTATA[T,G]GCTAAAGAGCAGTAGGTTTCAACCC | 1,045,079 | 92 |
| 2912. | ACACAGAAATACAGACTTCTCTCT[A,G]GTTCTTACTCATGCTGCAGACCATC | 1,045,610 | 92 |
| 2913. | TTCGTGGCAGAATAACAGAAAAGT[C,T]CAGAGATAATAGAAGGGTGAAGAGA | 1,045,663 | 92 |
| 2914. | TAAACATAGTGAAGCTTTGAAAAT[A,G]TACTTCTGTTACTATGCCTTGCAAT | 1,045,712 | 92 |
| 2915. | CTTGTAGTGCATGCCAAGTCTCAA[T,A]AAACATAGTGAAGCTTTGAAAATAT | 1,045,736 | 92 |
| 2916. | GATAGGATAAATACATTGTGAACT[T,C]GATCTATTTCACCTATGAAAGAGCA | 1,045,833 | 92 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 2917. | ATGTGCAAAACCTTAGAATTACCG[G,C]ATAGGATAAATACATTGTGAACTTG | 1,045,857 | 92 |
| 2918. | ATTTGATGTGCAAAACCTTAGAAT[T,A]ACCGGATAGGATAAATACATTGTGA | 1,045,862 | 92 |
| 2919. | TCGAAATTAAGATTCAGTAGCACG[G,A]TATGGTTATTTGATGTGCAAAACCT | 1,045,894 | 92 |
| 2920. | CAAGTTGTTTATGATCATTTGAGT[T,C]ATAAAATTATCGAAATTAAGATTCA | 1,045,928 | 92 |
| 2921. | TGTCTCTGGTTTTGTTGTGCCACC[A,G]AGTTGTTTATGATCATTTGAGTTAT | 1,045,951 | 92 |
| 2922. | AAAATCATTTTGTAGTCATGCTGA[T,C]GGCACTGTCTCTGGTTTTGTTGTGC | 1,045,981 | 92 |
| 2923. | AAGCAATCCATGTAATGGAATTGA[A,G]CTGCAAGACATCAAGCTCACCTATG | 1,046,044 | 92 |
| 2924. | GTCTTGAGTATTTGTTTCAAGGCC[T,A]GACGTCATAAAACAGTGATGGTGCT | 1,046,766 | 92 |
| 2925. | GTCCTGGCCATGGCATCAGGTAAT[C,T]AAGGGAACATGCATGTATTGCATTA | 1,047,464 | 92 |
| 2926. | TGTACATTACGAGTCCACCAATTT[G,A]AAAAAAGACCATATAATAAATTAAT | 1,052,907 | 92 |
| 2927. | TTACGGGAAAAGTACGTGGAAGTA[C,T]AAGGGAACATGCATGTATTGCATTA | 1,053,273 | 92 |
| 2928. | AGGTCttTtTTTTTTTCCTCTTTA[C,A]GGGAAAAGTACGTGGAAGTACTGTT | 1,053,294 | 92 |
| 2929. | GATTTCAAAAAGAGTGTCTACTGC[A,G]CATTAATCCATTTGGTGAGGCACCA | 1,053,350 | 92 |
| 2930. | GATTATAATAAAAGTGAACATCAG[G,A]CCGTTCATTAACGCCTCACTAATCA | 1,053,684 | 92 |
| 2931. | TTGTCTTCAGTTCTTTCTTTTTCC[C,G]TTGTTGGGTGTAGGCCCCCCAAAT | 1,053,837 | 92 |
| 2932. | ACAAGACAATATTTTCAAAAGTTC[T,A]TATGATAAGTCTGCAGAGGAAAAACC | 1,053,980 | 92 |
| 2933. | ATGGGGGCAGTAATTTTGGTCAAT[G,A]ATGTCTTGCAGTCCAATTCCGGTGC | 1,055,501 | 92 |
| 2934. | TGGCTTGTTTCCGTAGGTAAGCTT[G,T]ATGTCTTGCAGTCCAATTCCGGTGC | 1,055,902 | 92 |
| 2935. | CAACTCGAAGAGTCAGAAGCAACT[T,C]GGCACAACAGAACCAGAGGCAGTAC | 1,055,980 | 92 |
| 2936. | CATTCCATGTCTACTAGAGTAACG[C,G]TTGGACATGGAGGATAAGAAAAGTT | 1,056,097 | 92 |
| 2937. | TATCAATCCATTAAATATTTATTC[C,T]ATTCCATGTCTACTAGAGTAACGCT | 1,056,121 | 92 |
| 2938. | AGACGATTGCATTCCTAATTAGAG[A,G]GATTCAATTTAAAAATTATACAAAC | 1,056,577 | 92 |
| 2939. | TTCTCTAATTAGACGATTGCATTC[C,T]TAATTAGAGAGATTCAATTTAAAAA | 1,056,587 | 92 |
| 2940. | CTAATTAGACGATTGCATTCCTAA[G,T]CAGAGGGATTCAATTTAGAAATTAT | 1,056,649 | 92 |
| 2941. | TGGATGTTTTCGTGGGTATTTATA[T,C]GTACACTTACGGATTATATGTATGT | 1,062,643 | 92 |
| 2942. | CACCAGGATGGTCGCAGGTCCCGG[C,G]GAGCCGCAGGCGGCGTCCCATGCAC | 1,062,871 | 92 |
| 2943. | TGCCCCGGCCATCGATGGTCCCGC[C,T]GGACACAGAGAGACCCTGGACTCCA | 1,063,064 | 92 |
| 2944. | CAATAGGAAAGAAATAAGGATCAA[A,C]TGAAGGACCGCCCGAGGAAACGTAC | 1,063,167 | 92 |
| 2945. | TAAGACGGAGAATAAATTACAATA[G,A]GAAAGAAATAAGGATCAAATGAAGG | 1,063,186 | 92 |
| 2946. | GAATTACGTTATCATATGAGTTAA[G,C]ACGGAGAATAAATTACAATAGGAAA | 1,063,207 | 92 |
| 2947. | AAATAAAATACTGAAGCTACAGCA[G,A]TCATACCTCCTCGTCTTCAGGAACG | 1,064,468 | 92 |
| 2948. | AGCCATTATTTTTtCTTCCTTGAA[G,T]GTACGTTAGCCATTAATTATATGCT | 1,064,653 | 92 |
| 2949. | CAGATAATATCATACTTACCATAG[T,C]TGTGCTAGGGACATGAGGTTAGCC | 1,064,699 | 92 |
| 2950. | TGTATAGAAGTATGGAGCTTCCGT[T,C]AGCACGGTTCTCGAAAAaGAAAAAA | 1,065,057 | 92 |
| 2951. | GTATCAAAAAAAAaTATAATGAA[G,A]TTTAGAAAATGTACTTTTGTTACTA | 1,065,344 | 92 |
| 2952. | TCTCAATCACTTGTACAGTACTTG[C,T]AGTGCATGCCAAGTCTCAATAAACA | 1,065,408 | 92 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 2953. | GATCACTTGAGTCATAAAATTATC[G,A]AAATTAAGACTCAGTGGCACAGTAT | 1,065,566 | 92 |
| 2954. | TGCAGTGAAAGCAATCCATGCAGT[G,A]AAATTGAGCTGCAAGACATCAAGCT | 1,065,702 | 92 |
| 2955. | TTTCTTTtGTTTTCGATAGAATTC[A,G]TCTGCATCACAAGTGGTCATGAACT | 1,065,757 | 92 |
| 2956. | AAATTGAAAAATTTTTTtGCTATG[A,T]ATTTTTGAGCTTTCATTTTCTTTtG | 1,065,798 | 92 |
| 2957. | GATACAATCCAAGCCCATGCAGAGT[C,G]AGTGGCAACCTATGTCATCTTTTGG | 1,066,133 | 92 |
| 2958. | ACTTTCTTTATGCATGAAGCCATC[G,A]TTGGATTGCACAATGGTCGCTTCAA | 1,066,251 | 92 |
| 2959. | GCAGTCCCCACCAGATTTGGTCAT[G,A]TAGCATTACTTTCTTTATGCATGAA | 1,066,283 | 92 |
| 2960. | TATGCATACTTGTACGAGGAATTC[C,T]TGCGTCAAAAAATTCTTTGGGACCAA | 1,066,433 | 92 |
| 2961. | AACGGAGAAAAGATCACTATGCAT[A,G]CTTGTACGAGGAATTCCTGCGTCAA | 1,066,450 | 92 |
| 2962. | CACCATCCTTCGTCTTCCACTATT[C,A]ATGTGCGAGAATAACGTGAATAAAA | 1,066,639 | 92 |
| 2963. | ATGAAATTAAGTTCATTTGCAGGG[A,G]GAAATGCGTCATATTGGGGTGGGGC | 1,066,702 | 92 |
| 2964. | CCTGCGGTCCTGGCCATGGCATCA[T,A]GTAAGGGAACATGTATGTGTTGCAT | 1,067,110 | 92 |
| 2965. | CACATTGTGATCGATGACTGTCAG[A,G]GAGTGATGGTACAAGGTGTCAAGAC | 1,067,306 | 92 |
| 2966. | TGCAGTCGTTAGCCTTCCATGGCT[T,C]GAAGAACATCATGATAAGTGGGCTG | 1,067,380 | 92 |
| 2967. | TAACTTAATTATGCGATAACTTTA[A,T]TTCATCATTTCTTCATGCAGTCGTT | 1,067,420 | 92 |
| 2968. | CAATTGTTTTCGTCAGAGGATGAT[C,G]AGGTTGAATCGCATTTTAGGATGGT | 1,067,654 | 92 |
| 2969. | ATTTGCCTCTCCAACAATTGTTTT[C,T]GTCAGAGGATGATCAGGTTGAATCG | 1,067,668 | 92 |
| 2970. | ACGACACCTCTTTGATAATTCGGA[C,T]AGTATCTATAGACTCTGCATCTAGC | 1,067,788 | 92 |
| 2971. | ATATATATATATTTCTAAATTTTA[G,A]TTATTTAAAAATTAATTTTTTtATT | 1,067,927 | 92 |
| 2972. | AAGTCCTTAAATTTCTCAATAGCA[G,A]CAGCAATATGATCATATTTTGGAGT | 1,069,271 | 92 |
| 2973. | AAAGCTTGACAAGCTGAAAATGCT[T,A]CAGCCACATACTCTATTTCAGAAGA | 1,070,096 | 92 |
| 2974. | TCTCGGGGATGCTTGCTTCTTCTC[G,C]CAGCCACAAAAACCTCCCAAGATAT | 1,070,959 | 92 |
| 2975. | GGTGGTATCCTGGCCAGACATCCA[T,C]CCAACACCCGTGCCTTCAGAACTCT | 1,071,130 | 92 |
| 2976. | AGGATCTTGGGAGGTGGTATCCTG[G,A]CCAGACATCCATCCAACACCCGTGC | 1,071,142 | 92 |
| 2977. | TTtTCTTTCTTCCTGCTGCATCGC[G,A]TGGTACTGAAAGGATCTTGGGAGGT | 1,071,177 | 92 |
| 2978. | CCCGTGGAGGCGAGCTCTTTTGTG[A,G]CTGATCCACGTATTTTGATTGTTTT | 1,071,242 | 92 |
| 2979. | ACTTCAGGTGAGAGAGAATTGGGT[A,G]TACAAGGGTTGAGGGTGAGGTCTCC | 1,071,330 | 92 |
| 2980. | AAGAGAGAGAGAGCTTTTGTGAGG[A,G]GAACTTCAGGTGAGAGAGAATTGGG | 1,071,357 | 92 |
| 2981. | AAGGAGCAGGAGGCTCCTTGACAG[C,T]GGTCGCCAGGCTCTTCAGGGGTTCA | 1,071,417 | 92 |
| 2982. | ATCTGAGAGCGTGGGTGGCTGGCTCCCG[A,G]TCTTGATCCGACGGTCCAGGGGCTA | 1,071,623 | 92 |
| 2983. | ACCCGGCTCAAGTTTGCTTTGGTT[G,A]ACTAGAATAAAAGTGAACATCAGGT | 1,079,120 | 92 |
| 2984. | CCCCCTCCTTTTCGTCTCTTTTCC[T,C]CCTCTCCTTTTCCCCAAATGAGAAA | 1,079,244 | 92 |
| 2985. | AACTAGGGGTTTTCTCTTTTCCCC[C,T]CTCCTTTTCGTCTCTTTTCCTCCTC | 1,079,265 | 92 |
| 2986. | CGAATGCAAGTTTCTATGATAAGG[C,A]TATATTTTCAAAAGTTTGTATGATA | 1,079,477 | 92 |
| 2987. | GTGAGGGTAAATGGGTCATTTCAT[A,G]TGTTACCACCTACCGTTGCGCCGG | 1,080,311 | 92 |
| 2988. | TTACTATGTACGTAGAACAGCAGT[C,G]AGTGGCAACAATAAAAAGCTGTGA | 1,080,357 | 92 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 2989. | ACGACTGCATGGAGAGGAGCACAA[T,C]ATAACATATGGTCAGCTCAATTTAC | 1,080,403 | 92 |
| 2990. | TCGAGTTCCTGAACACTAACGACT[G,T]CATGGAGAGGAGCACAATATAACAT | 1,080,421 | 92 |
| 2991. | CCGTCACCGCCTGGCAGCCATCGA[A,T]CACGATGTGGAACCTCTCGCTATTG | 1,080,502 | 92 |
| 2992. | ATGGCCAGGTCCGCAAGTGACCTT[C,T]TCGATCCATAGGTTCGTCGTGCCAG | 1,080,681 | 92 |
| 2993. | CATCACACGTGTGAGTGTTCCAAC[G,A]TAAGCATCTTATACGCGTGAAACTC | 1,080,781 | 92 |
| 2994. | CCGTTATGTTCATGAGAATACCGA[A,G]CATGATAGAATACGTTATTCTATAC | 1,081,141 | 92 |
| 2995. | TTAAGGCCGAAATTATTATCAATA[A,G]AAAaGACATATCGATCCATTAAATA | 1,081,672 | 92 |
| 2996. | CACCCTTGAGGACTTTTTGGGCAC[T,C]GGACGAATATTGCGTCGTTAATTGG | 1,081,743 | 92 |
| 2997. | GGGCTTGTTTTTGAGTGTAGGCCA[A,G]AATTTTGAACTAAGTTTTCGTCTCT | 1,081,922 | 92 |
| 2998. | AAATAaAAAATATAAAAATAATA[C,T]TTAGTACTTCACATAACATTAAAAT | 1,082,475 | 92 |
| 2999. | TCCTTGATGTAATGATGATCCACT[G,A]GTCTCTCTTTTTTATATTTAGGGAT | 1,082,601 | 92 |
| 3000. | TTAATCCAAAATAAATTGATTAAC[T,G]TACTTTAACCTAATTGATTTTAAAC | 1,083,078 | 92 |
| 3001. | CCACCCTCCTTGCCACATTCTATA[G,T]ATGCCCATTTTCTACATATAAAATA | 1,083,280 | 92 |
| 3002. | GTCCGAGTTGGGAGAGGCGGTGCA[A,G]GCTTTGTCATCCGTGGTCCGGATGA | 1,083,976 | 92 |
| 3003. | AGAACCCCTACCTTAGGGGTTTGT[T,C]AAGATAAAATTTGATGGTAGTGTCC | 1,084,022 | 92 |
| 3004. | TAGGGTTCTATCCATTTCTTGAGA[A,G]CCCCTACCTTAGGGGTTTGTTAAGA | 1,084,043 | 92 |
| 3005. | TCCTTGGCTTGATCCATCAGAGTA[T,C]GGTTGATTGGATGGCTATGGATGGT | 1,084,288 | 92 |
| 3006. | TCGTTCGGTGGGGGTGATTTAGGA[T,A]GCCTGAGTTTTGAGCATTCCTTTAT | 1,084,851 | 92 |
| 3007. | GGGATCTATTCCTTATTGACGAAG[C,A]GGGAGGCTCTGCTTGCCAGACATGT | 1,085,067 | 92 |
| 3008. | AATTTTAAAAAaTAAAAAaTTAGT[C,A]TTTATTTATAATAAAATTTTTCATC | 1,091,438 | 92 |
| 3009. | TTTATTGCCAATAGTTAAAAAAaT[C,T]AAAATTTTAAAAAaTAAAAAaTTAG | 1,091,465 | 92 |
| 3010. | TTTCGTCGTCAATAATATTATTGG[T,C]GATGAAAAATAAAATTGATCATAAA | 1,091,911 | 92 |
| 3011. | TCTTTCACTTCTTCAGGGATCGAT[A,G]GATGAGGTCGCTAGATGAGGACTGT | 1,092,506 | 92 |
| 3012. | GGAGGGATCCGAAAGGAGATCTTT[C,T]ACTTCTTCAGGGATCGATAGATGAG | 1,092,525 | 92 |
| 3013. | AGCTACGGAGGAGTGACGGTGGTA[T,C]TGTGGCTGATAGTGGAGGGATCCGA | 1,092,563 | 92 |
| 3014. | GGCTTACTTGAGCATGAGTTGGGG[A,G]AGCTACGAGGTAAGCTCTTTGAGCA | 1,092,747 | 92 |
| 3015. | AGTGACATCTTCCAACGATTGAG[C,T]GGGTTGAGGCTGATATTGAGGAGCT | 1,092,822 | 92 |
| 3016. | ACTTTTTGTCTTTGAGAGCCTTGA[T,C]GGAGTTTGTCTCCATTGTCCACTTC | 1,094,138 | 92 |
| 3017. | TGACCTTGACCGTCCATTACGATC[G,A]AGGACCGCTGGGGTTCACCCGTGCA | 1,094,263 | 92 |
| 3018. | ATCCAACTTGACCTTGACCGTCCA[T,C]TACGATCGAGGACCGCTGGGGTTCA | 1,094,271 | 92 |
| 3019. | TCGAGCTGGGGTTTCATGGTGAGG[A,G]AGATGCGTGATCGTTTGAAAGATGA | 1,094,870 | 92 |
| 3020. | AAGATCGTATCCCTGCATCGGTGG[T,C]TGGAATTTGCACTTAGGAGTGCTTT | 1,094,982 | 92 |
| 3021. | GGACATGCATGCTTTCAATCTTCT[A,G]GTTTGTATTTTTTtGAGTCAACTC | 1,095,032 | 92 |
| 3022. | AGGAATAGTTTGCAAATGATACAA[C,T]GGACATGCATGCTTTCAATCTTCTA | 1,095,057 | 92 |
| 3023. | ACCTAAATCACATTTTTGAAATAG[G,A]AATAGTTTGCAAATGATACAACGGA | 1,095,079 | 92 |
| 3024. | GACGTTTTGAGATTCTTGTCAAAA[G,T]TGGGACAATTATTTCATTTTTGGTA | 1,095,247 | 92 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 3025. | TATATATTAAATTATTACTGTACG[G,A]GTGCTTAGCAATATTTTAAGCTCTGG | 1,095,426 | 92 |
| 3026. | ATATATACATATATATTAAATTAT[T,C]ACTGTACGGGTGCTTAGCAATATTT | 1,095,435 | 92 |
| 3027. | ATGAGTTTTAATTTAATTCTTTAA[C,T]ATCATAATATTTTTTtATTTAATTA | 1,095,595 | 92 |
| 3028. | ATATTGATATTTGCATCTATTATT[G,A]TATATTTAGATATAAATTTTTAATT | 1,096,413 | 92 |
| 3029. | GAGTTAGACTATAATTTAAATCTA[A,G]TTAAGGAAACTGATCGTTGGCTGTA | 1,096,830 | 92 |
| 3030. | AAAaATAAAAATTATACATATTCA[C,T]CTCTGCATGAGTTTTTTTTTtGAAT | 1,097,000 | 92 |
| 3031. | GATTAATTAATATTATATAATTTT[T,A]AAAaAATAAAAATTATACATATTCAC | 1,097,025 | 92 |
| 3032. | CATCAAAACCTCCTCCGCCTCTCT[C,T]CTCCTTCCTCATCCCCACAACCATC | 1,098,467 | 92 |
| 3033. | AGTTTTCCCCTACCCAATCTCATG[G,A]CATGGATGAGGATAAGGCCGTGAGA | 1,098,663 | 92 |
| 3034. | TCGACCAAAATAGAGGAAGTTTTC[C,T]CCTACCCAATCTCATGGCATGGATG | 1,098,680 | 92 |
| 3035. | AGAATCGGTCTCATTGGACCTGGT[A,T]AAGCATGAAGCCAGCAAAGATTGCC | 1,098,777 | 92 |
| 3036. | AGGGGGTGAAATTCCAGAATTGAC[A,G]TAGAGATGTCAAATTATGAAGTATT | 1,099,052 | 92 |
| 3037. | TCATAATTATGATGGATCAATATT[G,A]TTGCCTAAAGCCATTACTACCTAAT | 1,099,437 | 92 |
| 3038. | CTATATCTATTTGGTTAGATGGTC[A,C]AAGATATTATGTTTTATCATAAAAA | 1,100,201 | 92 |
| 3039. | TTTATGATTTCTATATCTATTTGG[T,A]TAGATGGTCAAAGATATTATGTTTT | 1,100,211 | 92 |
| 3040. | ATTTGGATTTTGACATCCATAAGG[A,T]AAATGACTAAACTCTTTACAATGTA | 1,100,315 | 92 |
| 3041. | AAGCAATCGTGTAACCAGATTAAA[G,T]TATTTGGATTTTGACATCCATAAGG | 1,100,341 | 92 |
| 3042. | TCACTGGACAGCTCATCATGTTCG[T,C]ATATTGTAGAAGTCCAATTCGGGGG | 1,100,754 | 92 |
| 3043. | CGGCGTCCCATGCATCAAGGAATG[C,A]TTTGGTCGAATCCGTCTCGCCATCT | 1,101,813 | 92 |
| 3044. | ATAATCGGTTGGTGCAACAAGGGT[A,G]CCGTCGATCTGGACGGTGATGTAGC | 1,101,953 | 92 |
| 3045. | TACAATAAGAAAGAAATATGGATC[A,G]AATGAAGGACCGCCCGAGGAAACGT | 1,102,146 | 92 |
| 3046. | AAATGACGAATTACGTTATCATAT[G,T]AGTTAAGACGGAGAATAAATTACAA | 1,102,191 | 92 |
| 3047. | ACCATGTGGTACAGCTCGCTGTTC[C,T]TCGACCTCAACCCACTGATCGTTAC | 1,102,283 | 92 |
| 3048. | TTAAAAATTCCAGCTCAGAAAAGC[C,T]GTAACTTATATATATATACATATTG | 1,103,302 | 92 |
| 3049. | GTTGGCATAATAAGAACAACAAAA[C,G]TGAAAATTTTATTTCGATATATTTT | 1,103,663 | 92 |
| 3050. | ACTTGGGTGGGTTAGATTGGATCG[C,T]GGGCAAACCCCATGCCAACTCAACC | 1,104,572 | 92 |
| 3051. | GCCATGCCTAAGTACCCAAGGCCT[A,T]CCTAAGCACTTTTAACAAAAACTTT | 1,105,060 | 92 |
| 3052. | AATACCTCTCATTGTTCTAAATTT[C,T]AATATATTTTATGATTTAGGGATTG | 1,105,165 | 92 |
| 3053. | TCTTTTtCTTTTATTGACTAGAAT[A,C]GGGAAAGCCTAGCTGAAAACTAAGG | 1,115,335 | 92 |
| 3054. | ATCTTTATTTTCTTTTtCTTTTAT[T,C]GACTAGAATAGGGAAAGCCTAGCTG | 1,115,345 | 92 |
| 3055. | TGGATTCAATCCTACCCGGTGTGG[T,C]TTCAAGTCAAAGATTAGCTTCAATC | 1,115,537 | 92 |
| 3056. | GGCTAACATGATATTTTACTACTT[C,T]AAGTTAAGAAAATCAGAATTTGACC | 1,115,681 | 92 |
| 3057. | ACTGCACCTGCCCCATGTTCTCCT[G,A]GTGAGTTGGTCAAAAGGATGTTGCA | 1,115,753 | 92 |
| 3058. | GATTGCATGCTGGTGAAAAGCTTC[T,G]ACCATAAAATGTCCACAGCTATGAA | 1,116,063 | 92 |
| 3059. | CCCATGGAGAAATGATTGCATGCT[G,A]GTGAAAAGCTTCTACCATAAAATGT | 1,116,076 | 92 |
| 3060. | GTTGTCTATTTCTTCTAATTGTCA[A,C]CCGAGATGATGGAGTAGCTGCAGAA | 1,116,663 | 92 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 3061. | TAAAGACGCACCGAAATTTGTATA[T,A]TTTGGTGGAGTCACAGCGTTATTGG | 1,116,962 | 92 |
| 3062. | AAAACATAAGGCAATGACTTATTT[C,G]GCATTTAGGTCAATTTGTCTACATG | 1,118,433 | 92 |
| 3063. | TAGAAATGAAAGTGTTCTGTGCTT[C,A]ATTTGGTTCATGAAAAACATAAGGC | 1,118,471 | 92 |
| 3064. | ACCTGAATACAGTGTATAGTGCAC[A,T]ACTAGTCAAGACTATTCAACATGAC | 1,118,720 | 92 |
| 3065. | CATGGAAAACACCTGAATACAGTG[T,C]ATAGTGCACAACTAGTCAAGACTAT | 1,118,730 | 92 |
| 3066. | TGTCCCTCGAATATTTTTGTAGTT[G,A]CATGGGTGATCTCAATGCCCGAAT | 1,120,076 | 92 |
| 3067. | ATGTTTGCAAGAAGACCATGCCCG[C,T]CGATTTTGATAGGTGAGCTTAATAT | 1,120,196 | 92 |
| 3068. | AGGGCATTCGAGTGTCGGCTTGAG[C,T]AGGCCAATGCACATACTACCCAATA | 1,120,335 | 92 |
| 3069. | GAGTCATTTAGAATAATCAAAAGA[C,A]AAAGAAAAGAAAGGTTCAAGGTGAT | 1,120,869 | 92 |
| 3070. | CAAAGAAAATGTTTCTCGTCCAAA[A,G]ACAAAAGTCAAAAAACAAAGATGTT | 1,121,150 | 92 |
| 3071. | GATAGATCTCAAATTAGATGCTTC[C,T]AATTTTATTCTCTCTCTATAAATTT | 1,121,651 | 92 |
| 3072. | GTTGATTAAAAAGATATTTAAGAA[A,C]GAAAAAGGTGGCTGGAGAATATTGA | 1,122,173 | 92 |
| 3073. | ATTTGGGTGGTGGTGAAACGGTCG[G,C]GCCAGGTGCAGCGGAGCTGGGCTTC | 1,122,409 | 92 |
| 3074. | CGCCATTTCCATTCCCCTGAGAGA[A,C]AGAGAGACAGAGAGAGATTTGGGTG | 1,122,450 | 92 |
| 3075. | CACAACTTTGGATACACCAAAGCC[C,T]TCTATCACCTTTTCAGGAATACAAG | 1,122,799 | 91 |
| 3076. | CTCAGTCTTCGAAATTAAACTATA[C,A]TCTTCCCAACCAGTTAGCCCTGAGA | 1,122,886 | 91 |
| 3077. | TTGTCTTTAAATTTGCTGGTACAT[C,T]TAGTAACAAAAACTTAAACTCGACA | 1,123,029 | 91 |
| 3078. | ACATTGAAGCTAAGCAATAATGGC[A,C]TGACAATGCAGCAAAGCATCATTTA | 1,123,240 | 91 |
| 3079. | ACACATTTTCCATAAAAAAGATTG[C,T]AACACCTCAGTAATTAGCTTCTTTT | 1,123,318 | 91 |
| 3080. | TGCCAGAAAGCATCCCTTAACTTA[C,A]AAGAAACTTGATAATTTTTCCTCTA | 1,123,407 | 91 |
| 3081. | GAGCAAATGCAAAAATAGAATAGG[C,T]AGACAAAATCTGTGGGATTGCCAGA | 1,123,450 | 91 |
| 3082. | CTAAATGAGCAAATGCAAAAATAG[A,G]ATAGGCAGACAAAATCTGTGGGATT | 1,123,456 | 91 |
| 3083. | ATCGAAGATAAAAGACCGTGTTTC[C,T]CAATATTGACCCATTCATATATAAA | 1,123,508 | 91 |
| 3084. | CATAATTTTTGAGTATCGAAGATA[A,G]AAGACCGTGTTTCCCAATATTGACC | 1,123,522 | 91 |
| 3085. | GCTGGTTCATAATTTTTGAGTATC[G,A]AAGATAAAAGACCGTGTTTCCCAAT | 1,123,529 | 91 |
| 3086. | TGCAATAGATCCGACAAAACGATC[G,C]AAAGATATAAAACACAGAACATATA | 1,123,591 | 91 |
| 3087. | ACAGATCTCATAGAATCCAGCATA[C,T]GCTGTAAAACCTGGCATACCTGTGC | 1,123,678 | 91 |
| 3088. | CTTTTGCCTTGTGCCTGCACTTCC[A,T]ACAACATAACAGCCATGTAGCTTTG | 1,123,801 | 91 |
| 3089. | TATCTCAATTAAAACAACTAATCC[C,T]AAGCACGCATGCGCGCGCGCACA | 1,123,909 | 91 |
| 3090. | TTATCTCAATTAAAACAACTAATC[C,T]CAAGCACGCATGCGCGCGCGCAC | 1,123,910 | 91 |
| 3091. | ATAGACTAGATGCAATAAACTAAG[C,T]CACGACTAGAAAAATTAAGATCCTC | 1,124,094 | 91 |
| 3092. | TAAAATAGCTTTCTAAGAACCCTA[C,G]AAGAAGAGAGGGTTGATAGGCAGAA | 1,124,314 | 91 |
| 3093. | CAGGTTTGGGTCATATTTTGCCAA[C,T]TACCATGATACAAGGGTCTATGGAC | 1,125,265 | 91 |
| 3094. | CATTACAGGAGTTTCAGAATATGA[T,C]CATTTCTATCAAGATAAAATGACAA | 1,126,245 | 91 |
| 3095. | AGCTCATTACAGGAGTTTCAGAAT[A,T]TGATCATTTCTATCAAGATAAAATG | 1,126,249 | 91 |
| 3096. | GCAATATACACCACAACCAATGTA[C,T]AAAAATCACATATTATCAGCTATTT | 1,126,428 | 91 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 3097. | TTGCAAACACTGTACATAACTGAG[T,A]CAAACATGTTCGAACAGCACTCTAA | 1,126,750 | 91 |
| 3098. | ACGGTCAACCATTGCCACCCCAGC[T,G]AATAAACAGCATATGCTTCTCCTTA | 1,127,553 | 91 |
| 3099. | AGAATTGTTTTCTTTTtGGTTTTA[G,C]CAACTTAAAAGACACTTTTGCCAAA | 1,129,764 | 91 |
| 3100. | TACAAGAAAACCATTCGAGTCTCT[C,A]CTCCAACACCAATATCTATATATTA | 1,129,874 | 91 |
| 3101. | CTCAATTTGAATTTGATCCTACAA[G,A]AATAGTATCCTATCATTATCCTTTT | 1,130,004 | 91 |
| 3102. | CAAAAATGACTCAATTTGAATTTG[A,G]TCCTACAAGAATAGTATCCTATCAT | 1,130,013 | 91 |
| 3103. | TCATAAAAATATATTTTTTTTtA[A,T]CCAACAAAAATGACTCAATTTGAAT | 1,130,042 | 91 |
| 3104. | ATATTTATTTTACTCTTATATTTG[A,G]AAAAGATGTTGCTAAGCATATATCA | 1,130,307 | 91 |
| 3105. | ATAAGGAAGTACCATTTGCGAGCC[A,C]AAAAACGCATATTATTGAATAATCA | 1,131,515 | 91 |
| 3106. | CCATCAAATCACAGCAACTTGTAT[G,A]CACAATTATTGAAAGGAAAAAaGaA | 1,131,595 | 91 |
| 3107. | TCAATCGAATAGGTTAGAATTAAC[C,T]TCAGAAAACGCCAATCACTTCCACC | 1,131,643 | 91 |
| 3108. | CAGATIATTTGGCCCGGACCCTCA[A,C]ACAGAAAACGCCAATCACTTCCACC | 1,131,898 | 91 |
| 3109. | TTACAGATTTAAATTAAGAGGACA[T,C]GAAATATAGTCAACTTGCCTTGACG | 1,133,875 | 91 |
| 3110. | ATGAACCTTAAATAAGGCAAAAAG[A,T]CTATAGTACTTAAGCTGTCCTTACA | 1,133,920 | 91 |
| 3111. | TCGAACATAGAAACCTGGATACAA[G,T]AATTCATTGTAAGTCTATATGAACC | 1,133,963 | 91 |
| 3112. | TGTGCTATGTATGTGAGAGGCAGG[T,G]AAAACTGCATCTCATGAATTGCAAA | 1,135,068 | 91 |
| 3113. | AGAAGTAAAATTTCACTTCAGGTC[T,G]GCAATATTCCATGCAAAACATTTCA | 1,136,142 | 91 |
| 3114. | TTTGCTATGGTTATGATTCTTAAG[A,G]AGTAAAATTTCACTTCAGGTCTGCA | 1,136,164 | 91 |
| 3115. | GAAGAACTAAATTGAACCGACGTG[G,A]ACCCATGAAAGAATAACATAAAACA | 1,136,245 | 91 |
| 3116. | TGAGACATGTTCTAATAGAGGAGG[T,C]GGAAAGCAATTGGAGAAAAGTTTCA | 1,136,308 | 91 |
| 3117. | TTACCATCGGATGGGATGATGCCC[T,G]GCTTCATGATTAAGTAGTCAACGTG | 1,137,548 | 91 |
| 3118. | CCAGACACTATGTGGGTGGTGCAT[T,A]CTAAAATGAAGCTATTATGACTTTT | 1,143,835 | 91 |
| 3119. | GAACACCATAAAGGAAATTCTGCT[G,T]GCATTATCCAGACACTATGTGGGTG | 1,143,867 | 91 |
| 3120. | ATAACATTTAAGAAAAACAGATAG[G,T]TCAATAACATTAATTCTGAGTGTTG | 1,144,335 | 91 |
| 3121. | AATTTACAGTGTCATAATTTCATA[A,T]TCTTAATAAAACCATCTTAACTAA | 1,144,384 | 91 |
| 3122. | CTTTTCTCAACATTAATTCTTGTC[A,C]AATAGATGAATAGAATCGAAGCAAA | 1,144,634 | 91 |
| 3123. | GGTGTAAGAGGGAATCAGTGTTGT[G,A]AAAAGCAAAGAACTTTTCTCAACA | 1,144,672 | 91 |
| 3124. | GATTTTGGATACCCTAGCCCTAGA[T,C]GATTATCATAATTTTGTTCAACACC | 1,145,105 | 91 |
| 3125. | TACTACAATTTCTTAGGAGATTTT[G,T]GATACCCTAGCCCTAGATGATTATC | 1,145,123 | 91 |
| 3126. | CAATGTTTAAGAGTCATGGGACAG[T,G]TAAAAaGAAAAaGTTAGTTGCTGCA | 1,145,813 | 91 |
| 3127. | ATGTATTTCCATATCAATTTCAAT[C,G]TTTTGGGGGTTATTTTGGATACAAT | 1,145,859 | 91 |
| 3128. | TTCTAGATGATCTAGGATTTTGGA[A,C]TCCATTAATCACAGGATGGAATGTA | 1,145,904 | 91 |
| 3129. | ACATTAGAACACTATGTTCATATC[T,C]ACATTTCCTGTTGTTTATGAAGGGA | 1,146,946 | 91 |
| 3130. | TCTTGTTGGTGATAGACATTAGAA[C,T]ACTATGTTCATATCTACATTTCCTG | 1,146,961 | 91 |
| 3131. | GCCTCGGTTCAGATGACAAAGATT[C,T]AGGTAGAGAGAAACAACAAAATCTT | 1,147,007 | 91 |
| 3132. | TTTTTGCAGCAAGAAGAACATTTC[G,A]AAAGAGCATTGATGTGTAGAAGTTA | 1,147,202 | 91 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 3133. | TCGATGCAAAGAAACATGCTACTC[G,T]AAAGAATATGAAGGTGAAAACCATG | 1,147,360 | 91 |
| 3134. | CAAAAGAATATAAAGGTAATCGAT[G,C]CAAAGAAACATGCTACTCGAAAGAA | 1,147,379 | 91 |
| 3135. | GCATTCCTTGGAGCTTTACTATGA[C,T]GGACATATCATAGAAAACATAATTT | 1,148,200 | 91 |
| 3136. | CAAGCTTCAAAGAAAGCATTGTCA[G,T]GAGATCAAAATGGACCCATGCAATA | 1,148,283 | 91 |
| 3137. | TATTCACATCCAACTCCAACATGA[C,T]AAGCTTCAAAGAAAGCATTGTCAGG | 1,148,307 | 91 |
| 3138. | AAGAAGAACAAGTTTTCCTTCTAT[T,G]CTCTATACAAAGGGCACTGATCAAG | 1,148,441 | 91 |
| 3139. | TACATACGTAAGCATGTTATTATG[C,T]TGTAATTTGTCTGAATCTATTTGTT | 1,149,365 | 91 |
| 3140. | AAGACAGGCAGACATAGTGCACTC[G,A]TTCAGATGCTATCATGTACTCAGGG | 1,150,477 | 91 |
| 3141. | ATATGTATTCCAACCATATATTAA[A,G]ATAGAAGGATATATAAGTACACTCT | 1,151,559 | 91 |
| 3142. | GTATATGATGAAAGTGGAAAATAT[G,A]TCAGCCTTCTTTTtCCTTCTTTTCT | 1,151,650 | 91 |
| 3143. | GAAAATATGTATATGATGAAAGTG[G,A]AAAATATGTCAGCCTTCTTTTtCCT | 1,151,658 | 91 |
| 3144. | GGAGTATTTCATGTAGGCATTTTC[A,G]ACATACTGTAAGAAAAAAaTGAATG | 1,151,772 | 91 |
| 3145. | TGTGTCTTTCCACCATCCCTGTTT[G,A]GCACAAGTGGCATATGTTTTGTCCA | 1,151,898 | 91 |
| 3146. | GAAGCTTAAATGTGTCTTTCCACC[A,G]TCCCTGTTTGGCACAAGTGGCATAT | 1,151,908 | 91 |
| 3147. | GCTTAAGGATGTCTTCTTAATTAG[C,A]AAAAGAAAAaGGAAAAAaGGAATTG | 1,152,940 | 91 |
| 3148. | CAAAGAGTTAGTGGATGGATGGAG[A,G]TTTTTATCAAACCTATTTATTAGAA | 1,153,071 | 91 |
| 3149. | GAGTTTTGTATTAGATAAAAGACC[T,A]ATTTTGATTCAAAAACAAATCAACA | 1,153,379 | 91 |
| 3150. | ACAAGAATACATCATAATTTTCAA[A,G]CATATGTTGTTGAAAGAAGCTTATT | 1,153,683 | 91 |
| 3151. | CACCTGCCCATATTGCATCACTAG[T,A]ATCCTACAAAAGGGGTGCAAGTACA | 1,153,902 | 91 |
| 3152. | ATATAATCTATTATAATATTATTA[C,T]ATTATAATAATACAATATAACATAA | 1,158,751 | 91 |
| 3153. | ATTATAGTATATATTATATTTATAT[G,T]ATATGATAATAATATGATACAATAA | 1,158,845 | 91 |
| 3154. | TAATATAATAATAAATTAATATTA[C,T]GATATATTATAAATATATAATATAA | 1,159,079 | 91 |
| 3155. | CATCCTTCCAATGGTGGAACTTTA[C,T]GATATATTATAAATATATAATATAA | 1,159,669 | 91 |
| 3156. | TAAGCTCGAGGAAATTCTTATATC[T,C]GCCCAAAGTAGTTTCAAACCCAGCC | 1,159,746 | 91 |
| 3157. | ATCGGCTGTGGTGCTAGTTAGCTG[C,T]TGCTGTTCTCTTCTTGAGAGGTTCT | 1,159,818 | 91 |
| 3158. | TAAAAACTGCAAAAGGAACCAGCC[A,T]GAAGATATCGGCTGTGGTGCTAGTT | 1,159,849 | 91 |
| 3159. | CGTGAGTCTTTGACTTCTTTTGCC[G,A]TTTCTTTCACTGTATCCTGTAAAAA | 1,160,444 | 91 |
| 3160. | AATTTAGTTCAAATGCTCATGACG[C,T]TAAAAAAGCAAACAGAAGAAGTGAA | 1,160,598 | 91 |
| 3161. | GTTCCATATGGTGGGATTCCCATA[T,A]ACTTACACATATTAACCAATCTTGG | 1,160,846 | 91 |
| 3162. | AATAATTTTCTTCGAAGCATAAAC[C,T]GCAAATAATTATCTGTTCCATATGG | 1,160,885 | 91 |
| 3163. | GGATGATGCATTTTCTTTGAACTT[T,C]AAAAaCATATAACCTACCAAAATAA | 1,160,930 | 91 |
| 3164. | CGGGCAAGCCATGGGCTGACCCTG[C,G]TCAGTGTGCACTCCTAAGTGAGGTG | 1,161,113 | 91 |
| 3165. | CAACCCATACCATAAAAATATTGG[C,T]CCAACCTTCTTATGATGTATGCTGG | 1,161,164 | 91 |
| 3166. | CTCATAAATCATTGGCCCAAGCCT[A,G]GCCTAATTTTAGTTGGGCCAAAACT | 1,161,228 | 91 |
| 3167. | ATATATATGCCAACTGTACATATA[T,C]GTGCTATAGAAGTATTGCCTCAGGC | 1,161,295 | 91 |
| 3168. | AACTTTCCAGCTTTTTAGAAATCT[G,A]AAAGCACTTCTTAATATTTTACCAA | 1,163,216 | 91 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 3169. | TCCAAAATAGAACTTTCCCAAGTA[G,T]AACTTTCCAGCTTTTTAGAAATCTG | 1,163,241 | 91 |
| 3170. | CTTCCAAACATCAGTCAAGTAGGG[C,T]TCTTGAGAAAATCTCCAAAATAGAA | 1,163,279 | 91 |
| 3171. | TATTATAATATAATGTCATTATGT[T,C]GCTACGAAATTTTCATTAAAAaCA | 1,163,336 | 91 |
| 3172. | ATATTATTATAATATAATGTCATT[A,G]TGTTGCTACGAAATTTTCATTAAAA | 1,163,340 | 91 |
| 3173. | ATCTCCTTTATCACAGAGTGAAAG[G,T]TTGAGAAAGTACTTTTGGTATGACA | 1,163,969 | 91 |
| 3174. | TATTCAAGTATAATGTCACAATGG[A,G]TTTTTTAACTAGAAGTATCTCCTTT | 1,164,010 | 91 |
| 3175. | TAATACGACATATTTTATCAAAAG[C,G]AATGGCAATTAACTATGCAAACAAC | 1,164,175 | 91 |
| 3176. | AATATTCAATATCAATCTCCCAAT[T,C]TTTGCACATTATTTCACATCATGAA | 1,164,281 | 91 |
| 3177. | CCTTCCAGACCTCCAAAGAATAAT[A,G]TTCAATATCAATCTCCCAATTTTTG | 1,164,302 | 91 |
| 3178. | ATAATAACTTGGAGAGCTTAGTAA[C,T]ATTGATTTCTATAATATTGTGTTTA | 1,164,422 | 91 |
| 3179. | TCACAACATATAATAACTTGGAGA[G,C]CTTAGTAACATTGATTTCTATAATA | 1,164,431 | 91 |
| 3180. | TGTCTGCTTAAGAAACACAAACAA[A,G]CATCACAACATATAATAACTTGGAG | 1,164,458 | 91 |
| 3181. | TGCAAAAAAGAGGTCACATTCATA[T,C]GTTACAATGAATCACAAGTAATATT | 1,164,604 | 91 |
| 3182. | ACACAATATAACATGGAGATCATC[A,G]TCACTAGGCACAATCATCTAAATAT | 1,164,701 | 91 |
| 3183. | CATGGTACCAGTACAGGTCTGGTA[C,T]TGAGATTGTGAACATTGACTAAATG | 1,164,860 | 91 |
| 3184. | CATCGTCCTAATTTTACCACCTAG[C,T]ACCGTCATATTAACTAGCAAGATTC | 1,165,022 | 91 |
| 3185. | ATCATGTAGTTACAATCTTCAAAA[G,C]CAGCCACTCTTATTACCTCTCTCTT | 1,165,373 | 91 |
| 3186. | CTTCTGAAGTATGTGTTATCTTCC[G,A]AGGTCCTTCAAGCTGCAGAATCTGC | 1,165,686 | 91 |
| 3187. | CTTCCATGCAAAAGGGGGTGGTC[T,G]GCAAACTATGCCACTTTAACACCAT | 1,165,858 | 91 |
| 3188. | GTGGATCATTATCAAATTCAGATT[T,A]TATATATATATATATAAAGCCCGGA | 1,165,914 | 91 |
| 3189. | AGACTGAATTCTAGACAAAGAGAG[T,C]TGAAATTAATTAAAAGAAGCAGTGA | 1,165,984 | 91 |
| 3190. | CATGCTTGCCTAAGTTCACATTCT[A,G]AAAGAGATTCTACACCCTCTGCCTG | 1,166,136 | 91 |
| 3191. | GGTCCCTACATGCTTGCCTAAGTT[C,A]ACATTCTAAAAGAGATTCTACACCC | 1,166,144 | 91 |
| 3192. | CAGGCATAAGAAAACTTTAAGAGA[C,T]TTGTTTTTAATTGGGTCTATCATTT | 1,166,274 | 91 |
| 3193. | ATAAGCAAAGAATTTCCTTAGTAC[A,C]GGCATAAGAAAACTTTAAGAGACTT | 1,166,297 | 91 |
| 3194. | ACAGTAGACTCTAGAAATGCTATT[A,T]AGTATAAAGAAAATAATTGCAGTAA | 1,166,497 | 91 |
| 3195. | AGGTGAGGACGTCAAATCAGACTC[A,G]AGTATAAAGAAAATAATTGCAGTAA | 1,166,569 | 91 |
| 3196. | TCTAAGAAATGACATCCAAATTAA[T,A]CAGGAGGAAACAACATATATTTaaa | 1,166,801 | 91 |
| 3197. | TATTTCCAGAAACAGTGAAAGCTC[T,A]AGAAATGACATCCAAATTAATCAG | 1,166,823 | 91 |
| 3198. | CATTAATCTCCCAATACTGATACT[A,C]AACAAATAAGGTAATGATAAAGGAA | 1,167,054 | 91 |
| 3199. | TTACATTTCAAGCTTATGCAACTA[G,C]GAACAGCATTCTAAGATAAACTTGA | 1,167,235 | 91 |
| 3200. | AGCAAATCATCAAGACCATTGGTT[A,T]ACCTGATGTCAATCCCTAACAAATT | 1,167,343 | 91 |
| 3201. | CCAGTAGCAAACAATTTAACATAA[T,G]TAACTAGACCAATAGATATGAACCA | 1,167,476 | 91 |
| 3202. | TAGAAACATGCTTTAACAATTGCA[C,G]TCATACAACATTGGCTTGCTAATGA | 1,167,565 | 91 |
| 3203. | AGTAGAGTGCAAGATTATACAGAT[C,T]TACTCACAATTAATTCTGCAGGAAA | 1,167,632 | 91 |
| 3204. | TATGATCATCTAGTCTTCCAATGT[C,T]TTGATTTATGTTGTCTGCTTCTACA | 1,167,713 | 91 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 3205. | ACTGAAGTTTAGACTTTAAGTCTT[T,G]GAGACTAATAATGTTTTGCATTAGA | 1,167,787 | 91 |
| 3206. | TGAGCATGAGAACATCTCGTGACA[C,G]TACAAAGATAATAAGAGCTAAATAG | 1,167,974 | 91 |
| 3207. | AATCTGACCTAATAATCTGGAGCT[G,C]GATACACTCACTCATACAGGAAAAT | 1,168,175 | 91 |
| 3208. | CAATGAAATCACATCATCTATCAT[T,A]TGCGCCACAGTGAATTTGAATTCAT | 1,168,326 | 91 |
| 3209. | AACAATATCAAATCACATGCAAAC[A,T]GTTTTCGAGTTTGATACATGAAAGA | 1,168,395 | 91 |
| 3210. | GCTGAAGCTAGAACAGCTAATGCA[C,T]GGCTGATTTTACAGAGGTCTTCTCT | 1,168,849 | 91 |
| 3211. | TTAACAAGACTCAAGAACTCTTGA[C,T]GCTCCCTGCTGACAGACTGCAAGGT | 1,169,005 | 91 |
| 3212. | AAGATGAAATATACCTCTTTGTTA[A,G]CAAGACTCAAGAACTCTTGACGCTC | 1,169,026 | 91 |
| 3213. | GGTCAGTATTCTCCCTGACTGCAC[T,C]ATATGCTTTCTTAGCTGCTTCTCAT | 1,169,252 | 91 |
| 3214. | AAAAGCATGCGGAGAAAATGTCAA[T,C]ACCATTTAGTTAAATATGTTTCCAA | 1,169,407 | 91 |
| 3215. | CATGGTGCACATTTGCACATACTC[A,G]GTATATGGAAGGGTTGTGATAGGAA | 1,169,462 | 91 |
| 3216. | GTTCTAGAAAATAAGAAAAACATA[C,A]TGAAAACAAGGGATTTGTAATTGGT | 1,169,601 | 91 |
| 3217. | AATTCTCCCAAGAAACTTTATAAC[T,C]GATACTGTTACATCCACCTTAAGAA | 1,169,705 | 91 |
| 3218. | GCATTATATAATCCCCTATCCCCC[A,G]AAAGAAGTATCGAAGGAAGAAATAT | 1,169,855 | 91 |
| 3219. | AACAAAAaGCAAAGAATAATTACC[T,C]GTCAAGTAGCTGCCAGCAGTTACCA | 1,169,979 | 91 |
| 3220. | GAATAAAGTTTTAGTAGATAGGCC[G,A]ACTAAGTTGTGGAACAACTGAATAG | 1,170,233 | 91 |
| 3221. | TTCATGATATAACACCAAAAACAA[C,G]AAATATAGTTGTTTTAAATTCGAAT | 1,170,279 | 91 |
| 3222. | CATAGAGTFTCTGAGGGAAAAAGC[G,T]AATCTGCATAAAATATTCATGATAT | 1,170,319 | 91 |
| 3223. | GAAGTAGCATAGAGTGTCTGAGGG[A,G]AAAAGCGAATCTGCATAAAATATTC | 1,170,326 | 91 |
| 3224. | AGAAAAACCAAAGAGGCAAAATTA[A,G]AAAGTGTCTTGGTCTACAGCCATGT | 1,170,383 | 91 |
| 3225. | TCATAGAGTGAGAAATTTCAAATA[C,T]GGAAAAAAaGAAATCATCAGTTACA | 1,170,483 | 91 |
| 3226. | ATGGCTGCAGCTGCAACCTCTTCT[G,A]GTGTCACTTTGCCATCATGATCACT | 1,170,555 | 91 |
| 3227. | GCAATCAACCTCTATCCCTAGAAA[T,G]GTTGCTGATGAGTTCCTGGACATCC | 1,170,632 | 91 |
| 3228. | TCTGTTTCATCTCCATTGGCATCA[T,G]CTATTTGACTGCCTAGCTTGACTAT | 1,170,823 | 91 |
| 3229. | CAATTGTATTACCAACGACTGAAG[T,C]TCTGTTTCATCTCCATTGGCATCAT | 1,170,848 | 91 |
| 3230. | ACTATCTTATATAACCACATATAT[A,C]CATAGGTTATTTTGACCAGGCCACC | 1,170,952 | 91 |
| 3231. | CCCTAGAAAAAAaTAAAAaTAAAA[A,G]GATGAATAAACTGAACATGGGTTCA | 1,171,221 | 91 |
| 3232. | TCAGCCAAAACAACTAACAGCTAC[A,G]ATGCATGCAATAAATATGGGCCCC | 1,171,268 | 91 |
| 3233. | ATATCGTTAGCTAATCAGCCAAAA[C,A]AACTAACAGCTACAATGCATGCAAT | 1,171,282 | 91 |
| 3234. | GACATTGGACAGAAACGGCACTCC[G,C]AGAATTACGCTAACAAAATGCTGCA | 1,171,472 | 91 |
| 3235. | CCAAAAGACATTGGACAGAAACGG[C,T]ACTCCGAGAATTACGCTAACAAAAT | 1,171,478 | 91 |
| 3236. | TCACAAATAAATGTAGGGTCATGC[T,C]GAACCGGCATATCTCCAAAGCCTCA | 1,171,696 | 91 |
| 3237. | GCTCATTCTATTTGTAATGAGAGT[G,T]GGAGAAAACTTTGGGTTGGTTACCG | 1,171,786 | 91 |
| 3238. | TCAAAGCCCACAGCTATAATGCTT[A,G]ACTGAAGCTTAATGCCTGCGAGTCT | 1,171,879 | 91 |
| 3239. | ATCTCAAGGTCGAAAGATGAATAC[A,G]GAAAAGAGACAAACTACTCTCGGAA | 1,171,949 | 91 |
| 3240. | ACAAAACCACAAGATGGACTGGTT[T,C]TCAAATCTCAAGGTCGAAAGATGAA | 1,171,978 | 91 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 3241. | AAGACCAATCCACCAACCCACTGC[T,A]AGTTAACACTGGTGAATTGGAATGG | 1,172,031 | 91 |
| 3242. | TAATGGAGAGCACAAGAAGACCAA[T,G]CCACCAACCCACTGCTAGTTAACAC | 1,172,047 | 91 |
| 3243. | AGCGAACGGATGAGAGGAAATTCT[T,C]AATGGAGAGCACAAGAAGACCAATC | 1,172,071 | 91 |
| 3244. | AATAGAGAGCGAATCTCCTGTTCA[G,A]TTGGAATCCTAGGGAGACAAACAGG | 1,172,133 | 91 |
| 3245. | TAACTCAGCAACGTCATAGTAACT[A,C]AAATGGAGTCTTGTTCCAAGAATGT | 1,172,262 | 91 |
| 3246. | AAGAACCATTCCGACATCCTAACT[C,T]AGCAACGTCATAGTAACTAAAATGG | 1,172,281 | 91 |
| 3247. | TTGCATTATGttTTTTTTTTTtCA[G,A]ACCAACTAGAGGAACGCTATAAATC | 1,172,348 | 91 |
| 3248. | ATCGTCTAATATGTGTTATACAGC[C,T]CATATTGCATTATGttTTTTTTTT | 1,172,377 | 91 |
| 3249. | AGCCGTTCTTTTTATCGTCTAATA[T,C]GTGTTATACAGCCCATATTGCATTA | 1,172,390 | 91 |
| 3250. | ACTACATAACCCTCGCGTCTTTTT[G,A]GAATGGAGATCAAGCTACATCTCGT | 1,172,495 | 91 |
| 3251. | AGAAAGGAAGATGAAAGTAAAGGG[A,T]AaGTTCGATATTTTTtAAAATAAGA | 1,172,837 | 91 |
| 3252. | ATTCCATCGAAAACCTTCCGCACA[A,G]TCTCCAAATCGCCGTTGTTTATAAA | 1,173,372 | 91 |
| 3253. | AGAAACTATATCTCTTAGCCATTC[C,T]ATCGAAAACCTTCCGCACAaTCTCC | 1,173,392 | 91 |
| 3254. | TCAGCCCATATCTCGCATACCCAT[C,T]AACCATAATGCTCCAAGAAACTATA | 1,173,432 | 91 |
| 3255. | GTTATACAGCTCATATTGCATTAT[T,G]TTTTtATTTTTCAGACCAACTAGAA | 1,173,642 | 91 |
| 3256. | GTCAATAAAGAATGCCAAGAAAGT[G,A]TTATAGTTCGGACACTGATGGTAAA | 1,173,893 | 91 |
| 3257. | TTAATTTATGTCAATAAAGAATGC[C,T]AAGAAAGTGTTATAGTTCGGACACT | 1,173,902 | 91 |
| 3258. | GTCAATAAAGAATGCCAAGAAAGT[G,A]TTATAGTTCGGACACTGATGGTAAA | 1,173,902 | 91 |
| 3259. | AAATATCAATGAATTCTATGAAAA[C,T]TGATTCCTCTTGGGCATTGCATCAA | 1,174,776 | 91 |
| 3260. | GAATGAAGTCAAAAAAGGGACCAG[A,C]aGTTAATTACCTATTATTTTTGTTC | 1,175,255 | 91 |
| 3261. | CGGAGTCCATTTTCTCTTTTATGT[A,T]GAAGGAAAGGGAGGAACGAAGGAAA | 1,175,439 | 91 |
| 3262. | AGGGAGAGCAGCCTCCAACATAAC[C,T]GACACCTTGTGGAGAAGAACAAAGA | 1,175,539 | 91 |
| 3263. | CCATTCCATCGAAAACCTTCCGCG[C,T]AGTCTCCAAATCGCTGTTGTTTATA | 1,175,923 | 91 |
| 3264. | AGAAACTATATCTCTTAGCCATTC[C,T]ATCGAAAACCTTCCGCGCAGTCTCC | 1,175,941 | 91 |
| 3265. | TCCACGCTACCATATCTCGAGTAC[C,T]TGAATATCAATGAATTCTATGAAAA | 1,176,078 | 91 |
| 3266. | AAAGGTCCAAGGCTTCCTTGAACC[G,A]GCCATTCTGTGTGTATCCCGAGATC | 1,176,191 | 91 |
| 3267. | ACCACTAAAAGAATGCTTACAAGC[G,A]TGATTTATTTGGTGCCACACCTGC | 1,176,258 | 91 |
| 3268. | GCAACCACTAAAAGAATGCTTACA[A,G]GCGTGATTTATTTGGTGCCACACC | 1,176,261 | 91 |
| 3269. | TAGAGCCCGAATCAAGGATCAAGTC[C,T]ACTTCCATACCCATCTATCCATGTA | 1,176,351 | 91 |
| 3270. | CACTAGAGCCGAATCAAGGATCAA[G,A]CTGATAATTCTCTATGCTTGAGCTT | 1,176,354 | 91 |
| 3271. | CTATGCTTGAGCTTTTCAAAGATG[C,T]TAGCAGCATCCTCAATGCAGCCACA | 1,176,419 | 91 |
| 3272. | TATGTTAATTTAATTGTGTACCAA[G,A]CTGATAATTCTCTATGCTTGAGCTT | 1,176,455 | 91 |
| 3273. | ACTGTGTACTATATTCATTTAATT[G,A]TGTACCATATTTAGTTAACTGTGTA | 1,176,548 | 91 |
| 3274. | GTTACTTTAACTGTGTATATTATT[T,C]ATTTAACTATGTGCAGTGTTCATTT | 1,176,599 | 91 |
| 3275. | GTATCATGTTACTTTAACTGTGTA[T,C]ATTATTTATTTAACTATGTGCAGTG | 1,176,606 | 91 |
| 3276. | TATATACCATAGTTAATTAACTGT[G,A]TGCCATGTTAATTTAACTGTGTATA | 1,176,735 | 91 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 3277. | CATATTTATTTAACTGTGTACTAT[A,G]TTTATTTAACTATATACCATAGTTA | 1,176,770 | 91 |
| 3278. | ATATAGTATTTATTTGACTATGTA[T,C]tATATTAATTTAACTATATACCATA | 1,176,899 | 91 |
| 3279. | ACTATGTATATTATTAATTTAACT[A,G]TGTACAATATTTATTAAATTGTGTA | 1,177,198 | 91 |
| 3280. | CGGAGAAACGTGTCTATATAAAAA[T,A]AATAATAAATTAATTaAAAAAATTA | 1,177,943 | 91 |
| 3281. | TTTCTTTCCATTTCTTTATGTATG[A,G]TAAAATGATGGGAGGAGGATTGAAA | 1,177,993 | 91 |
| 3282. | AAGTTGGGGGAGTTGGCCAAAAGG[C,T]CAGTGGGGgAGGGTGCAAGCTCAGA | 1,178,386 | 91 |
| 3283. | GAGGATGTTTGGAAGATTGGGGTA[T,C]GGGTGAGGGCCAGTGAGAAGGGATT | 1,178,517 | 91 |
| 3284. | ATGCCAAGTATATTGAGGATGTTT[G,A]GAAGATTGGGGTATGGGTGAGGGCC | 1,178,531 | 91 |
| 3285. | TATGTATCATTTGGCAATATGGTC[A,G]CACTCGGGCCCGATCAAATGGTAGA | 1,178,844 | 91 |
| 3286. | CAGCCCTCCAACTCTGTCGTCTAT[G,A]TATCATTTGGCAATATGGTCACACT | 1,178,865 | 91 |
| 3287. | CTGCATGCAATGGCTCAACTCTCA[G,A]CCCTCCAACTCTGTCGTCTATGTAT | 1,178,887 | 91 |
| 3288. | TCACTATGGCTTCCACCTTTACAG[T,C]CCGAGTGTCGCCCTCTGCATGCAAT | 1,178,926 | 91 |
| 3289. | TGCCATCTTCATACTTGGATAACC[T,A]GTTCCCATCCGACTCTCACTATGGC | 1,178,966 | 91 |
| 3290. | GGCGTCCACATGGCAAGCCAAGAT[C,T]ATAGGCCCCACCATGCCATCTTCAT | 1,179,004 | 91 |
| 3291. | AAGAAAAGCATCTAAGCTAGGTCT[G,A]GACAAACCCTTAATTATAATTTTAG | 1,179,116 | 91 |
| 3292. | CCTATGGGAAGAAAAAAAaCCTCT[G,A]TGAGTCTTTTTCTTCTTCTTGCAAC | 1,179,169 | 91 |
| 3293. | GCCTCGCCTCCTTCCTCCATTACC[G,A]TCTTTATTATTTCGTCTTTCTGACG | 1,182,789 | 91 |
| 3294. | AAGGGTCGGACCGCTCACTGACTG[T,C]GGCACGAGCGGGACGGCGCCGTCGT | 1,183,067 | 91 |
| 3295. | GGTGGTGGAAGACTTTCGCGGCTC[C,T]GACACATATCGGGAGGAACTCCTGG | 1,183,297 | 91 |
| 3296. | TTAGAGTCGTAGAGTCGTAGACCC[A,G]ACATGCCATGTTAGGTCACTCGGTA | 1,183,798 | 91 |
| 3297. | CGAAGGTTAAAGTCGAATGTGCGT[C,T]GTCCCGACATGAGTTGGGCACGTTC | 1,183,993 | 91 |
| 3298. | ATGGCGTCCGACACGTTTAGTCAG[G,A]AAAATGATGACAAGTCGAGTTTCCA | 1,184,188 | 91 |
| 3299. | CGGGGCTCGTACTTCCTGGCGAGC[G,A]CCGACCCACAGTCGAAGAGTCGAGA | 1,184,542 | 91 |
| 3300. | TCGAAGAGTCGAGATTCCAGACTC[C,T]GAGATTTTGAAATTGAATTTGTATT | 1,184,578 | 91 |
| 3301. | CATCTTGTAGGGTCCTTCCCAGTT[T,C]GGAGCTAGCTTCCCTCGGTCTAGAG | 1,184,751 | 91 |
| 3302. | CCATACGAAGTTACGCCTCGCGTC[A,G]AAGTTCGGACAAGAGGTCTAAGTTG | 1,184,903 | 91 |
| 3303. | CGATCTCCAGCGGGATCATGACTT[T,C]CGTTCCGTAGGCTAAGTTGAAGGGA | 1,185,014 | 91 |
| 3304. | ACACCTCCGAACCAATTCAGCCGC[A,G]TCCTTCTTCATAGTGAGCCAGTAGT | 1,185,576 | 91 |
| 3305. | AGGATTTGCCCCCCAAGTGATTAC[T,C]GCAGATCCCTTCATGTACTTCTCTG | 1,185,653 | 91 |
| 3306. | CAGGCACTTCAGCAAGGGAAGAGA[G,A]AACGATCTTTTGTATAGTCAGCCAT | 1,185,729 | 91 |
| 3307. | GAGAGAACGATCTTTTGTATAGTC[A,G]GCCATCCACCATCACATATTGGGAA | 1,185,749 | 91 |
| 3308. | CGGATCCATCCAATTTGGCTCTGT[C,T]GCCAATTGCAGCACCTCTTCGATCT | 1,185,870 | 91 |
| 3309. | TTCCAGACTTTTTATGAATGTCCG[A,G]CTCAAGGTGCCGTAGTCGGATGTCG | 1,185,936 | 91 |
| 3310. | CTTTTTATGAATGTCCGACTCAAG[G,A]TGCCGTAGTCGGATGTCGCGAGCCT | 1,185,943 | 91 |
| 3311. | TCGCGAGCCTGGAGAGTACGTCGG[C,T]CCGAGCATTTTCCGCCCTGGGGATG | 1,185,983 | 91 |
| 3312. | CGCCCTGGGGATGTGAAAGATCTC[A,G]AAGTATTTGAAGGGTGCTACGAGAT | 1,186,020 | 91 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 3313. | GACGAGCGCCTCATATTCGGCTTG[G,A]TTGTTGGAGGCCTTGAAGTCGAACC | 1,186,209 | 91 |
| 3314. | GTTGTTGGAGGCCTTGAAGTCGAA[C,T]CGGAGGGCGTGCTCGGTAACCACTC | 1,186,233 | 91 |
| 3315. | TTGAAATTTATGTGAATACCCCTC[T,A]AAATTGATATTTGTATATCCTCAAA | 1,196,408 | 91 |
| 3316. | CATATATACTTTTATAAAATACTT[G,A]TTTTGCATGAATAACCTtTTTTTTT | 1,196,679 | 91 |
| 3317. | GCCAATTATTGCTCAAAGTGATAA[G,A]CTGGGCTTGTTTTGGTCAAGATTGG | 1,196,915 | 91 |
| 3318. | GAACATCATGGAATTTGTGGCCAA[T,G]TATTGCTCAAAGTGATAAGCTGGGC | 1,196,934 | 91 |
| 3319. | GGAAAGGAGTGAGGAGATCAGGAG[G,A]AATGCAAGGAAGTGGAGGGAGTTGG | 1,197,021 | 91 |
| 3320. | TGGAGAGGTGTGTGAGGGTGGTGA[T,C]GGAGGGGGAAAGGAGTGAGGAGATC | 1,197,052 | 91 |
| 3321. | CTAAGTATATCGAGGATGTGTGGA[G,C]GATCGGGGTGCGAGCGAGGGCCAAT | 1,197,130 | 91 |
| 3322. | TGTGGCGCCGATGGTTGGAGTGCC[G,A]CAATGGACGGACCAACCGATGAATG | 1,197,180 | 91 |
| 3323. | CCCTAAGAACTTCATAGAGGATTT[A,G]TCCTCGGAGCGAGGGCTAGTGGTTT | 1,197,327 | 91 |
| 3324. | TCACTCTGTATTCTATCTCGTGCT[T,G]tGCCTCTATTCATGTTGCTGGATTT | 1,198,502 | 91 |
| 3325. | CATTTGCCTCGCATATAAAATCCC[G,A]GCCCAATTATTGGCGAATTTTCGTC | 1,198,734 | 91 |
| 3326. | TAATGAAATGATCATCCCTCGGCA[T,C]TTGCCTCGCATATAAAATCCCGGCC | 1,198,756 | 91 |
| 3327. | GCAGTAACTGAATTCAGATTACCA[C,T]cATGGTCGAGCCACCTTCGATAATG | 1,198,801 | 91 |
| 3328. | TTGGCAAAGATTGGGACACGTTTA[C,T]TTTTCTTTTtGTTTATAACAAATTT | 1,199,193 | 91 |
| 3329. | TGTTTCCTAATTTAGTGCAATTGT[T,C]TGGCAAAGATTGGGACACGTTTACT | 1,199,217 | 91 |
| 3330. | AATTTTAATTACTTCCAGTGAAGT[A,G]CAAATTCTATCTTGACCTGGGAACC | 1,199,412 | 91 |
| 3331. | TGAGCCTTTTCCATGCATCATATT[A,T]ATTTTCAAAAGTTACACGAAGCCTC | 1,199,573 | 91 |
| 3332. | AGCTTGaGTTGTTAAGGATTCAAT[A,T]TGAGAGCAGAGATGAGCAGGAGTTT | 1,199,692 | 91 |
| 3333. | AAGAAAAAAAAaTCTTATAGCTTG[A,G]GTTGTTAAGGATTCAATATGAGAGC | 1,199,710 | 91 |
| 3334. | GATCCATCATCCCCCTCCTATCTT[C,T]TTCCATCTCTCTTTTTCTCTCTTTT | 1,213,581 | 91 |
| 3335. | AATGTCcACACTCCCTTGGCTgCT[C,T]TTCAACAATCGgATGGCTCTCCCAA | 1,213,638 | 91 |
| 3336. | TTTGGCTACTGGATTCATCTCACT[C,T]TCCCCCTCTCTTTCTCTATCTGTAT | 1,213,752 | 91 |
| 3337. | CATCTTGCAAGGAGATGGCATGCG[G,A]CCATTCATCTTTGGCTACTGGATTC | 1,213,782 | 91 |
| 3338. | TCTCCCCCcTTACCTCTCTTTCTC[T,C]CTCTCTTACTCCTCTAGTCTCCCTC | 1,214,058 | 91 |
| 3339. | CgTGATGACTTTAATTATATACAA[C,T]TCATCAGAAGCCTTTTAGAGAGAG | 1,214,330 | 91 |
| 3340. | ATTGTTCATATATTATTTTCAGCC[G,A]TGATGACTTTAATTATATACAACTC | 1,214,353 | 91 |
| 3341. | CAATAGCATATAAATATCAACTTC[C,T]TATATTTTCTTCGATGGATATTTCC | 1,214,427 | 91 |
| 3342. | ATCATCAGATTTACAGAAGTAAAT[C,T]AATCAATCAGTAGATTGATAAATTA | 1,214,560 | 91 |
| 3343. | AGGATTATTAACTTCTTTAGCACT[A,G]GTTCAAGTGCATATGTCATATCTAC | 1,214,610 | 91 |
| 3344. | TTTGAATAATTATATCTTTGCCAA[C,T]AATGATTTGAGTAGGATTATTAACT | 1,214,647 | 91 |
| 3345. | TATAGTTTTATGCACTATGCCATC[C,A]TTTATATTAAATACAAATTTTCAAA | 1,214,720 | 91 |
| 3346. | ATATATAtaTATTAGATTTGATTT[A,G]AGGCTTAAAATAATTATTTTTATAA | 1,214,850 | 91 |
| 3347. | TCCAGTGTGTGGGGTCGCCTTCCT[C,T]AAAGGAGCAGCCTCCACCCACTTTG | 1,215,495 | 91 |
| 3348. | TCCGATGGGTGCTAGTATCCATGT[C,T]GACACTTTGGCACCAAACTATAAAC | 1,215,605 | 91 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 3349. | CCACATCAGAGCTCCCAGCCTCCG[A,G]TGGGTGCTAGTATCCATGTCGACAC | 1,215,625 | 91 |
| 3350. | AGCTGTGGTTCCACATCTCATCAG[T,C]CGAAAAAATATAGGGAGAAAAAAAa | 1,215,704 | 91 |
| 3351. | CATCATGCAGAGAATGTTTGGGTC[C,T]AATGTTTTGATTATAGCTGTGGTTC | 1,215,743 | 91 |
| 3352. | GCACCGCATCCATCATGCAGAGAA[T,C]GTTTGGGTCCAATGTTTTGATTATA | 1,215,753 | 91 |
| 3353. | AAATAGTTCAAACCAAGGCCATGA[G,A]CTAATACAAATTTACCCAAACAATG | 1,215,826 | 91 |
| 3354. | TTCATCCTTATAACAAATTAATTG[T,A]ATCAATCAAATAGTTCAAACCAAGG | 1,215,858 | 91 |
| 3355. | GCCTCACCTCCATGTTCAGCACCA[T,C]CTTGGATTAAGCTCTTGAAACCTAA | 1,216,033 | 91 |
| 3356. | ACATTTGCCTCTGCCTCACCTCCA[T,C]GTTCAGCACCAtCTTGGATTAAGCT | 1,216,045 | 91 |
| 3357. | CACGATCATTTGCTTCCCCTGAGG[T,C]AGCTCCACCACCCACATTTGCCTCT | 1,216,083 | 91 |
| 3358. | ATGGAGCACGATCATTTGCTTCCC[C,T]TGAGGTAGCTCCACCACCCACATTT | 1,216,089 | 91 |
| 3359. | CAATCGAAACTTAAGAAACCCTTC[T,C]AGAACATGGAGCACGATCATTTGCT | 1,216,119 | 91 |
| 3360. | CTCTAATCTCTCTCATTGTGCTCT[C,T]GTTTCTCACATATCTCTAAAAAAAa | 1,216,316 | 91 |
| 3361. | TCAGAAAAAGCAATTGGAACCTT[A,G]GAGACCTCTCTAATCTCTCTCATTG | 1,216,348 | 91 |
| 3362. | ATTTTTtAAAATTAATATTTAATT[T,A]TATTTATTTTCTGAAGATCTGACCC | 1,216,519 | 91 |
| 3363. | TATAACCTATGTGGTGTAATTTTT[T,G]AAAATTAATATTTAATTTTATTTAT | 1,216,537 | 91 |
| 3364. | AGTTTTATCATGCAAGAGCATTAA[T,C]CATAGAAGCATATTATGCACGCTTG | 1,216,866 | 91 |
| 3365. | CATATCCAGTTTCAAGAGTAATCT[G,A]ATTTTACTGAGTAGACTAAATTCAA | 1,218,151 | 91 |
| 3366. | GGAGCAGTGAGAAAGTTGGGTGAG[A,G]TTCGTTGCATATCCAGTTTCAAGAG | 1,218,183 | 91 |
| 3367. | GCATACACATGATGGAGCAGTGAG[A,G]AAGTTGGGTGAGATTCGTTGCATAT | 1,218,196 | 91 |
| 3368. | TGAATTGAGTTGTGCAATCAAAGG[T,C]ATTGGGATAATCAGCTTGCATACAC | 1,218,238 | 91 |
| 3369. | GATTTGTATATGATCTTTGATGAG[G,A]TATCTACTTCTTTTCTTTAGTGAAT | 1,218,372 | 91 |
| 3370. | GCGGCAAAAGATCGCAAGATAGGC[G,A]GTCCAGGTCCAAGTCGAGGGATTGG | 1,218,545 | 91 |
| 3371. | GATCACTTCTATACTTTTTCAGAA[C,T]GAGATTCTCAGACGTGAGAATTGAG | 1,218,624 | 91 |
| 3372. | TATCTTAGCAACTTCTAAAAGGTC[T,C]tCACTGAACTCCTTAGTATTGGTGA | 1,218,785 | 91 |
| 3373. | TCTCACCAATGCTCTCTTTCTCTG[A,G]AAGTAGTTCTACCAGTTGTGGATGA | 1,218,858 | 91 |
| 3374. | TGCTTAATGAGACTTCTCTGACGG[C,T]GATATGATCGAAGCTCGAGAAGATG | 1,218,922 | 91 |
| 3375. | GGAGCTGAATCGATCAATTTGAAG[G,A]TAAACAGGTGAAGAACCAGCAGTAA | 1,219,883 | 91 |
| 3376. | TATTTTAAATATCTATGTACGCAT[A,G]CTAGTATCATTACTTAATAAACCAT | 1,220,262 | 91 |
| 3377. | CTTTGTGTGAGAAGTTCTGGTATT[T,G]TAAATATCTATGTACGCATACTAGT | 1,220,282 | 91 |
| 3378. | CGATAACTTTTTTtATGTTTCGAT[A,G]ATAGCATTTGTCACCAGTGATGTTT | 1,220,474 | 91 |
| 3379. | GATCGGTAAGCCAAGAGTGATGGC[A,T]aTATTTATAAAAAATCGATCTTGTa | 1,220,690 | 91 |
| 3380. | AACAGTAATATTTGTTGTTTAGGA[C,G]GAAAaAGATATTAAATGCATGATAA | 1,220,821 | 91 |
| 3381. | TCTAGTTCCTATTCAGTCTAATTT[C,T]TTTAGTTCCATGCAAATCCTCTTCT | 1,221,070 | 91 |
| 3382. | TGAGACTATGTCAGTGAAAACTTT[G,A]TCAGTTCTTGAATAAGGACTCTAGT | 1,221,114 | 91 |
| 3383. | GCTCACTTATAGCTGCCTATAACC[G,A]TCTAACAAACTCCTCTAATGGCCTA | 1,221,256 | 91 |
| 3384. | AATTTATTTCTGGATCAGATCGAT[A,T]GAATATCGATTTGATTCAATTCAAT | 1,221,564 | 91 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 3385. | TCTCTGGCACATGATAATATTAGA[A,G]AGAATTATTTGAGAATTATATTGAT | 1,221,617 | 91 |
| 3386. | AATCTAAAGGTCAAAAGTTATATG[C,T]AAGTGACCCGACTTGCCCACTTCGA | 1,221,697 | 91 |
| 3387. | GAGGAAAATCTAAAGGTCAAAAGT[T,C]ATATGCAAGTGACCCGACTTGCCCA | 1,221,973 | 91 |
| 3388. | GAAGATATGCCCTCAAAGAGGAAA[A,G]TCTAAAGGTCAAAAGTTATATGCAA | 1,221,990 | 91 |
| 3389. | CATTTGATGTGAAGCACCTCCATC[T,C]ATGGGCTGGACTTTGCAACATCGGT | 1,222,074 | 91 |
| 3390. | AGATGAGATGAGACACCTGATCTC[C,T]GgATTGGACCATACAAATACTTATT | 1,222,146 | 91 |
| 3391. | AGTCAATAATACTCCCAACCAAAT[C,T]AGGATAACTTGAAGTGAGGCACCTG | 1,222,224 | 91 |
| 3392. | AAAAGCTGATCAAAGTCAATAATA[C,A]TCCCAACCAAATCAGGATAACTTGA | 1,222,237 | 91 |
| 3393. | CCTTCTTTCCCATGTAAGGCAAAA[C,T]CATGAGGCCCAAAATGACCATGGCC | 1,222,464 | 91 |
| 3394. | TATGAGGGAATAGCTAGTTTAGTT[C,T]CATATCGGTTGTGAGTCAAGAGGGA | 1,222,536 | 91 |
| 3395. | AATAATTTTCAAGTCCTGTATAGG[A,T]TAGTTAAACTTAGATCGGGCTATGA | 1,222,615 | 91 |
| 3396. | TAcACATTGGATTTATTAGTATCG[A,G]TTTgTTCTTAATTAACCAATCTAAT | 1,222,765 | 91 |
| 3397. | ATATTTCTTAAAATGTCTATCATA[C,T]ACATTGGATTTATTAGTATCGATTT | 1,222,787 | 91 |
| 3398. | ATCGGACAGAGATATTTCTTAAAA[T,C]GTCTATCATAcACATTGGATTTATT | 1,222,798 | 91 |
| 3399. | GAGAAAATCATCTGATATATGGGG[G,A]ATCCAATCTATCCACGACGACATCG | 1,222,844 | 91 |
| 3400. | TTCAAGGTTGACCTCATAAGGCAT[T,C]AACTTGACAAGTTTTGGCTCAAATT | 1,222,940 | 91 |
| 3401. | GGACCTGAGTTCTGATTAAGACTA[T,C]AACGTATTCAAGGTTGACCTCATAA | 1,222,971 | 91 |
| 3402. | TTTCAATATAGCCATCAACCAGTT[C,T]ATCAAGATGAACACCACATTGATGA | 1,222,072 | 91 |
| 3403. | TCAGAAGCAGTTTCACCTCCACTT[T,C]AATATACCACAGAGTAGCAATTAGA | 1,225,200 | 91 |
| 3404. | CTCCATCTGATTTTTGACTTATTT[T,G]ATAGATTTTTTtGAAGCATTTCAAA | 1,225,431 | 91 |
| 3405. | GCATCGAAGGGTTAAGAACTGGAG[A,G]ATCTCCATCTGATTTTTGACTTATT | 1,225,458 | 91 |
| 3406. | TAAAAATAGAAAATCAGGGATCCT[T,C]CAATAGTTAGTTTAAAATCCTAATT | 1,225,667 | 91 |
| 3407. | CTAACGGTCTAACAAGTTCTGTAA[T,C]GGCCTCATCAATCcTTCTATAAAAA | 1,225,711 | 91 |
| 3408. | AGTTCACTTACAGCTGGCTATAAC[C,T]GCATAACAAACTCTTCTAACGGTCT | 1,225,751 | 91 |
| 3409. | TATGTTACAACTTATCTCTAACTG[A,G]CACGTACAGTTAAGTATGATCTCAC | 1,225,829 | 91 |
| 3410. | AGAATTATATTGATCAAAATCTAC[T,C]TCTGGATCAGATCGGTTGAATACCG | 1,226,036 | 91 |
| 3411. | CCCATCTCTGGCACGTGGCAATAT[T,C]AGAGAGAATCATCTGAGAATTATAT | 1,226,076 | 91 |
| 3412. | GGATGAGGGTAACGAGATTAAATA[T,C]ATAGTAACTGTTGTAAGGGTTATAC | 1,226,280 | 91 |
| 3413. | AATTAGATAATTTGGTACTTAGGA[T,C]GAGGGTAACGAGATTAAATATATAG | 1,226,301 | 91 |
| 3414. | TAATATTTTTtATATAGGCAGCT[T,C]TGATGTTATGGATACGGAAATGAAA | 1,226,404 | 91 |
| 3415. | ACCCGTGGTCAAGTGATTTTTTTt[A,T]AAAATTCCCTTAATATTTTTtATA | 1,226,439 | 91 |
| 3416. | GCTTCGACTtACAACACAGCCCCA[G,A]CATCAATCTCTGCATGCAATGGCTC | 1,227,935 | 91 |
| 3417. | TCAGACTCTCACTACGGCTTCGAC[T,C]tACAACACAGCCCCAGCATCAATCT | 1,227,951 | 91 |
| 3418. | CATATGGCGAGCCAAGATCATAGG[T,C]CCTATGGTGCCATCCTCATACTTGG | 1,228,015 | 91 |
| 3419. | ATGGATTTCTATTCTATTATAGCC[C,T]AGCTTTGCAGCAATTGAGGATTTTT | 1,228,204 | 91 |
| 3420. | GAACGTGTTCTTAGATAATTTAAG[C,T]TAGCTAGGTCAATAGGCCCAATTCT | 1,228,844 | 91 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 3421. | GGTCTTGTATCAACCAAAATACAA[G,T]CTAGTTTAAATCCTAGAAGGAAAaA | 1,228,964 | 91 |
| 3422. | AGTGTGGTCTTGTATCAACCAAAA[T,G]ACAAGCTAGTTTAAATCCTAGAAGG | 1,228,969 | 91 |
| 3423. | TACTACTAGAGGACCGGTGCCTCG[C,T]AAGGATGAAGAAGAGTTCCGCTTGA | 1,229,157 | 91 |
| 3424. | AAAGTTtGTTGGATAATGAGTGCG[A,G]GTTAACTAGGTACATCCTTAACTAC | 1,229,294 | 91 |
| 3425. | TATAGCAGAGATAGAGTAAAAGTT[T,C]GTTGGATAATGAGTGCGaGTTAACT | 1,229,312 | 91 |
| 3426. | TAAAACTTTGTTGGATAATGAGTG[C,T]GAAAAACTTATGACTTAGGTTGTTA | 1,229,374 | 91 |
| 3427. | TGTGTTAGAGCAGAGATGAGTAAA[A,G]CTTTGTTGGATAATGAGTGcGAAAA | 1,229,394 | 91 |
| 3428. | CTACTTTTtGTTTTtAAATGTGGA[G,T]TAGCCAATGTATTTGAAAATCTTAT | 1,229,465 | 91 |
| 3429. | TTTGGACTACGGTTCATGTGGGTC[C,T]TGGATCTTCATGCGATCCGAGATGA | 1,229,559 | 91 |
| 3430. | AATTTAATTTCTTTGAGTAGGTTA[T,G]TAAAGGATTTGGACTACGGTTCATG | 1,229,591 | 91 |
| 3431. | ACTATAAAATTATTAAATATTATA[G,A]AATTATAAAAATTAATATTTTGAGA | 1,231,148 | 91 |
| 3432. | GTCCACATTGTGACCTATTGAAAG[G,A]AATTCTAGATTTCATTTTAATACGT | 1,231,201 | 91 |
| 3433. | TAATTATTTTTTtAAGATCGATA[G,A]TATTTGTGTTCAATAGGTTTTTGGA | 1,231,280 | 91 |
| 3434. | CAAATCTTAATTGTTTGCAGTCGG[G,A]TACGATGAAGTGAATGACAGTATTT | 1,239,773 | 91 |
| 3435. | GATAATGTTTTCAATTGGAGATCG[G,A]CCATTAGGCTATTTTATAACAAATT | 1,239,983 | 91 |
| 3436. | AAAATTAAGCTATTAGACGACCTC[C,T]GTATGATGGTGTTTTCAATTGGAGA | 1,240,012 | 91 |
| 3437. | AATTAGTGGGAAGGATAGACATGA[A,G]ATTTTCAAAAATTAAGCTATTAGAC | 1,240,044 | 91 |
| 3438. | TTTTCTTTCCTTTCAAATTTCATC[G,A]AAACAAAAGTCCCAAGCAAAATTAG | 1,240,088 | 91 |
| 3439. | TCGTACAGAATAAAGTCATTCATC[T,C]ATAGATACAAATCTCAAAGTACTAC | 1,240,138 | 91 |
| 3440. | ATCTATCCATTTATATAGATCGTA[C,A]AGAATAAAGTCATTCATCTATAGAT | 1,240,157 | 91 |
| 3441. | TATCCTCTATCATTCATCAATTTG[T,A]ATGAAATTTAAAATATTATATTTTC | 1,240,210 | 91 |
| 3442. | AATATTCTATTCTCTATCATCTAT[C,T]TATTTACATACATCTTAAATCACTC | 1,240,396 | 91 |
| 3443. | TTTgAAGTACTTCATCCTTTGTCA[C,T]CCATCTCAAAATATTCTATTCTCTA | 1,240,430 | 91 |
| 3444. | CATTGATCTATCTACACAGATTTT[G,A]AAGTACTTCATCCTTTGTCACCCAT | 1,240,451 | 91 |
| 3445. | ATCGATTTGCATGAATGTTGATGC[G,A]TTCCATCTTCTATCATTGATCTATC | 1,240,489 | 91 |
| 3446. | ATTTGTCTATACAGATCTTAAAAT[A,G]CTTCATTTATAATTTATTTATCTAT | 1,240,745 | 91 |
| 3447. | CATTCATTTACCTACATATATCGC[T,G]AAGCATTTTGTCTGTAATCCATTTG | 1,240,790 | 91 |
| 3448. | GCGAGCATAGATCGTGAAGTGCTC[T,C]AGCTTCAACCATCCATCCGCATATA | 1,240,867 | 91 |
| 3449. | AATCTTAAAATACTGCATCCTTTA[T,C]CATTCATTTGCGAGCATAGATCGTG | 1,240,901 | 91 |
| 3450. | ATTTACATAAATCTTAAAATACTG[C,T]ATCCTTTATCATTCATTTGCGAGCA | 1,240,910 | 91 |
| 3451. | ACTCATTTAACTATTCAATCCATT[C,G]TCCTTCGTATGTTCTTTACTTGTAT | 1,241,148 | 91 |
| 3452. | ATGGCATGAGGACTGTTCCATGCT[T,C]GTTTGTTTATTTTATTCCTTGAAT | 1,244,429 | 91 |
| 3453. | GGTCGGCTGTTTCCTgACGCACTG[T,C]GGATGGAATTCAACTATGGAGGGGA | 1,244,890 | 91 |
| 3454. | TTGGGTGGTGAGATCCTCGGAAAC[C,T]TCTAAGCTCCCAGAGAACTTCATGA | 1,245,010 | 91 |
| 3455. | TATGCTTGGCCCCGACCAAATGGC[T,G]GAGCTTGCATTCGGTCTTCTCAATA | 1,245,076 | 91 |
| 3456. | CCGCAAAATTAATTCTATTTTTtA[A,T]ATTTTtAGTTTTGAAATTAGAAAGA | 1,245,359 | 91 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 3457. | AGCTACAATATTAAAACTTAAGAT[A,G]TAGCCGCAAAATTAATTCTATTTTT | 1,245,387 | 91 |
| 3458. | TATTTTTAGTTTCATTAATTCTTC[C,T]TATCATCCACGATTGCAATTAGCAA | 1,245,850 | 91 |
| 3459. | TCTCTCTTTGCCATAATTCCATTT[A,G]TTACCCACTAAAAGACTTAGTTTGA | 1,245,994 | 91 |
| 3460. | ACAGCTTGGAATATTTTGTACTTG[T,A]CTCTCTTTGCCATAATTCCATTTAT | 1,246,018 | 91 |
| 3461. | TTGTGACAGCTTGGAATATTTTGT[A,T]CTTGTCTCTCTTTGCCATAATTCCA | 1,246,023 | 91 |
| 3462. | TGTTTCTGACTAGGAATAGTCATA[C,T]CTTCACCCAACAATATTCTATATCT | 1,246,394 | 91 |
| 3463. | ACTTAGATCTCAATGTGAGATGTA[G,A]TTCTAGCAATGATTTGATAAGCATT | 1,246,997 | 91 |
| 3464. | CATGCCCCTCTCCCTGAGAAGTGT[T,C]TGAGTAAAGAGACAGTCCTAGGCAA | 1,266,011 | 91 |
| 3465. | CGGATGAGCGACAACTCTCCAAAT[T,C]TAGGCAGCCTCAATCCGTCTAGAGA | 1,266,086 | 91 |
| 3466. | GTTGAGTGATCTTTTATACTCTCA[G,A]CTGAAAGTATCAACAGCAATGAGAT | 1,266,274 | 91 |
| 3467. | GGCCAATGAGATAAAGGAATGCTC[A,G]AAATCCAAGCATCCTGGATCACCCC | 1,266,368 | 91 |
| 3468. | CAAGAAATTGCGAAACTGCTGCTC[T,C]AGCCTTCTGACACAAGCCACGGGGA | 1,266,736 | 91 |
| 3469. | ACGCACCTCGTTATTCAAAATCCT[A,G]TTCTCCTACGCAGTAATACAGACCA | 1,267,910 | 91 |
| 3470. | CAAATTTTTGATAAAAATTTAATG[A,T]TTCACCACCTCCCTCTTATTCATTT | 1,275,287 | 91 |
| 3471. | GTACCACTTTGCCCAAAAAATACA[G,C]AGGAAGATGGACTATACAGATGTAT | 1,275,369 | 91 |
| 3472. | TCTCATCCCTTCTCACAATCCCAC[T,G]CTCATCTACTCTTGCTCGCACTCCC | 1,276,186 | 91 |
| 3473. | TGAAGCTAAAGTTATGGTCTTCAG[G,A]TCCTTTTAGTTGCTACTCTAGCTA | 1,276,371 | 91 |
| 3474. | TTCTGATGACAAGCAGCTTCCAAC[A,G]AGTCATCATAAACTTCATGTTACAT | 1,276,467 | 91 |
| 3475. | GAGCTTGCAGAAATGCCCTTTTCT[G,A]ATGACAAGCAGCTTCCAACAAGTCA | 1,276,487 | 91 |
| 3476. | TCTCAAGATGACTCATCCTGCTGA[C,T]TGTTAGAAAACTACGCAATGTTAAG | 1,276,568 | 91 |
| 3477. | AAAATGCTAATATTGAAGGTGTTC[G,A]CATCACACTAAGCACCGATCATGCA | 1,276,706 | 91 |
| 3478. | AAGGTGCTGAAAGACATTCATTAT[A,G]TTCTTCTTCTTCTTCTTATTCT | 1,276,912 | 91 |
| 3479. | CTCCAGTTCTACAAGAAACAATCT[G,C]TGCTTATCCTTGTCCTTTCTTCTTT | 1,277,099 | 91 |
| 3480. | TGAGGTTCTCCAGTTCTACAAGAA[A,T]CAATCTGTGCTTATCCTTGTCCTTT | 1,277,106 | 91 |
| 3481. | GGGAAATATCATAATGCCAGACCC[G,A]gAACATAGTATAGCAGAATTAGCAC | 1,277,239 | 91 |
| 3482. | CATCTTTTTGGTCAGGGAAGGTCT[G,T]GTACTTCGCTCATACCTTATTCAAA | 1,277,351 | 91 |
| 3483. | TTTACATCTTTTTGGTCAGGGAAG[G,A]TCTGGTACTTCGCTCATACCTTATT | 1,277,355 | 91 |
| 3484. | GGGGTTTATGGTGCAATCCAAGTT[A,G]CAGCAAGAGAGCCTTTCTCTGAT | 1,277,475 | 91 |
| 3485. | TGAAGGGGTTTATGGTGCAATCCA[A,G]GTTACAGCAAGAGAGCCTTTCTC | 1,277,479 | 91 |
| 3486. | TTCATAGGCTCATTGCCAAGGCTC[C,T]AGAGATGTGAAGGGGTTTATGGTGC | 1,277,511 | 91 |
| 3487. | TGGCGGAtGCGTTGTCATTAACGA[C,T]GCTAAAAaGCGCCGTTAAAAGTTAA | 1,277,752 | 91 |
| 3488. | AAACTGTCAACGCCGACGCTTTTA[G,T]CAAAAGCGTCGTTAAATAAAGAAAA | 1,288,154 | 91 |
| 3489. | TGCATGGCTGTTGGCTACCAAAGC[T,C]ATTGAGAAAAGCCAAACGTCTGAAC | 1,288,690 | 91 |
| 3490. | TTGCTAAACTGATGCGTTTTCTT[A,G]GGGGGTTTATAAAGCGATCGAAAGA | 1,288,863 | 91 |
| 3491. | AATTAAATAGTCAATTTGATTGTA[G,A]GTAGCTCAAATACTTGAAGATGTTG | 1,288,910 | 91 |
| 3492. | ATGCTCAGAATGTCCTCTACCTTG[A,G]CTCCAAGGCACATTTAACCTTCAAA | 1,289,146 | 91 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 3493. | ATTGAACTAGAGAGATCTGATACA[T,A]AATCACTAGCCCTCTGTGTCTTGCA | 1,289,355 | 91 |
| 3494. | CATTGAGGTCATCTGGAAATTGAC[G,C]ACCACTTTTGATAGATGAGAGTTGG | 1,289,423 | 91 |
| 3495. | TTACTTGCAAACAGGGACATGGCA[T,G]GGAGGTATCATCTAAAGAGCAATTA | 1,289,564 | 91 |
| 3496. | CAATTACTTGCAAACAGGGACATG[G,A]CATGGAGGTATCATCTAAAGAGCAA | 1,289,567 | 91 |
| 3497. | TTCTAATACAGAAAAGATAGTGTG[G,C]CATCAATCCAGTACAAATATCAGGT | 1,289,653 | 91 |
| 3498. | ATATAAATCAATGAAATTTAACGA[T,C]GAAAATTTGCTTAGAATAAACCAAT | 1,289,702 | 91 |
| 3499. | TAAGAAATTAAGAATATAAATCAA[T,C]GAAATTTAACGATGAAAATTTGCTT | 1,289,715 | 91 |
| 3500. | CACTTGTTATCATCTAAGCTTGAT[A,G]CTTTACAAGTCTACATTTTGCCTTC | 1,289,842 | 91 |
| 3501. | GATCATAATTTAGCAAAATCAGTG[C,T]TGTATTATACTGATGTTTTTCCCTC | 1,289,911 | 91 |
| 3502. | CATCCCACCATACGTGTGGGCCCC[C,T]AATGAAACCAAGCCCCACGCTAGTG | 1,290,538 | 91 |
| 3503. | GTGCCCACCGCATCCCACCATACG[T,C]GTGGGCCCCAATGAAACCAAGCCC | 1,298,548 | 91 |
| 3504. | GTCCGGGATCTGCCTGCGAGAGAA[T,G]GACACAAGCTGTGCCCACCGCATCC | 1,290,583 | 91 |
| 3505. | AAGGCATGGACAACGGACTCATTT[A,G]TTTGTTATGGTTGTGCAATTTGTTA | 1,294,974 | 91 |
| 3506. | ACGGACTCATTTATTTGTTATGGT[T,G]GTGCAATTTGTTATGGTGATAAAAA | 1,294,986 | 91 |
| 3507. | AAGAAATTTGTTCTTCACTTGCTT[G,C]TCATGTCACACACATTTTCAGTCCC | 1,295,175 | 91 |
| 3508. | ATCCTAAATTTGCATATCTGCATC[T,G]ATGGACACATGTTAAGAGGCAATAA | 1,296,045 | 91 |
| 3509. | CTATCCCTTATTCCTCGTTCTAAT[T,C]TTTATTGTTGTACATGTAGTCATTG | 1,296,105 | 91 |
| 3510. | CCGCCATTTCTCAGTTTGCAAGAC[T,C]CGTGTCCCAGGTGGTTGTGCACATT | 1,296,374 | 91 |
| 3511. | CAAGAAGGAAGAACTGAAATGGAA[C,G]CTGTTGGTCAGCAAAGTGATGGCAG | 1,296,649 | 91 |
| 3512. | TAGGTTGCCAAaGCTTGTTGCACC[G,A]TGACGGTGCCACCGTATGTAAAGAA | 1,296,855 | 91 |
| 3513. | TGTATTCTGGTGACTGTAACAATA[T,A]GGTGGAATTGAACAAAATTTTGTAT | 1,297,006 | 91 |
| 3514. | AGCTTGAGGATTGAGTTGGGAGAG[A,C]ACAGATTAGGGTTATCACGACCATG | 1,297,188 | 91 |
| 3515. | GGAGAGAACAGATTAGGGTTATCA[C,T]GACCATGGTTATGAATCGCTTTTGT | 1,297,206 | 91 |
| 3516. | GAGAACAGATTAGGGTTATCACGA[C,G]CATGGTTATGAATCGCTTTTGTCT | 1,297,209 | 91 |
| 3517. | ACAGGTAACCCCAGAGAATATCAA[T,C]TGGTGAGCAAAAATGAGGTAACAAC | 1,297,354 | 91 |
| 3518. | TGCTACTCTGCATTTTGAGTTTCT[A,T]CAATTGGCTCAAATTTACTGTCTGG | 1,297,408 | 91 |
| 3519. | TTGTTCTTTCTCTCTTTTTTTTt[A,T]TTTTGGCTCCCATCCTCTCGTTTTC | 1,299,247 | 91 |
| 3520. | GCTCCCATCCTCTCGTTTTCAGAG[C,A]AGAAAATACGAGTCTTAAATCACTC | 1,299,277 | 91 |
| 3521. | AAAATACGAGTCTTAAATCACTCC[C,T]TGACGCACTGTTCTAATCTCATTTA | 1,299,304 | 91 |
| 3522. | CTTGGTGTCATCATTTTGTCTTTC[T,C]TCCTTTCATCTGATGGTTCCCAGCT | 1,299,599 | 91 |
| 3523. | GGTTCCCAGCTATGCCATCCAGAG[A,T]CTCACTCCCTGTTCGTACTCCATTT | 1,299,638 | 91 |
| 3524. | CATCCAGAGACTCACTCCCTGTTC[G,T]TACTCCATTTAACTCACCCGGCGTT | 1,299,653 | 91 |
| 3525. | AATTTCTCCATATTTAATATTAT[G,A]TAAATTTTtCTTTTCCATCTATCC | 1,301,403 | 91 |
| 3526. | CACATCCTCCCTCTCCCTCCGATT[G,T]AGGCCATGAACTAATAACTGACCAG | 1,301,487 | 91 |
| 3527. | AGTTCCTTGTTCTCTCTAATTTTG[T,C]TTGTCCTAGTTTAGGATCTTTTTG | 1,301,767 | 91 |
| 3528. | TGTGGAATGAGATAGAGATCCTTT[T,A]TTAATTTTTtAATTGATATTCTTTG | 1,302,537 | 91 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 3529. | TTCAATTAAATTTGAAAGGTTGCT[G,A]TTTTATTGTGCTTCTGCTATGTGCA | 1,303,432 | 91 |
| 3530. | TATCAGCAAATATGCTTTATGCTA[T,C]GGTACCTAGACTCTCTATTTTTAAG | 1,303,928 | 91 |
| 3531. | TTAACATATCTTTTTCCCAGTGG[A,G]ATGTAGGGGAACTCTTAGTTTTAAG | 1,304,087 | 91 |
| 3532. | TTTAAGTGCTGGATACCTTCAATT[T,A]GAATATAAAGTTTTCAAGGTTTTGT | 1,304,131 | 91 |
| 3533. | CATATATATATATATGTCTATACA[C,T]GTGTATATATGCATACATAAATGCA | 1,304,562 | 91 |
| 3534. | TTACCGTACCATATGGTGTACCGA[C,T]ATCGTAACAGGATGGTACTGAGACA | 1,304,784 | 91 |
| 3535. | CCGTACCATATGGTGTACCGACAT[C,T]GTAACAGGATGGTACTGAGACAGTG | 1,304,787 | 91 |
| 3536. | TTATTCTAAACGTGAAAAACTATC[C,G]TGCAAGCACAAACTGAATAACCAAA | 1,305,022 | 91 |
| 3537. | ATAGAAGGATGGACGGAAATGATT[T,C]CCTCCTTTGTTTGGTATAGGAAAAA | 1,305,491 | 91 |
| 3538. | TCTATCCTTCCAATTTCATCCATA[A,C]ATTTTCTAATGACTCCAACAAAACA | 1,306,155 | 91 |
| 3539. | TTCTAATGACTCCAACAAAACATA[A,G]GGTAATTTTCACCGTAAGAAACGAA | 1,306,183 | 91 |
| 3540. | ACATTGTTGATTTAAACTAAAGCT[A,G]AAGTAAATATTTTTAAAGGGGAACT | 1,306,279 | 91 |
| 3541. | TTTTTAAAGTAATTAGTGACTTCT[C,A]CAAAATAGAAGCCCATTAACTAAAA | 1,306,364 | 91 |
| 3542. | ATGATCAAATCTGTTTCTGTATCT[A,G]GTTCGGATCAGATTTGAATAGAGAT | 1,306,721 | 91 |
| 3543. | TTGGATTTGAATATAGATATTAAG[g,A]TTTTTTtGGATCCAGATGCAGATAG | 1,306,868 | 91 |
| 3544. | CCTCTTAGGAGCCTCCAACTGTCA[T,C]GGATGAGAGGGTGTTGAGCCGCTCC | 1,307,273 | 91 |
| 3545. | TAGAATTCTCCTCAATCATCAATC[A,G]ATTGGCCCTTAGGACCCCTTGCATG | 1,307,358 | 91 |
| 3546. | GTCGAAGTTGACCTTTAGAAATCT[G,A]GGGGATGGGGGCTCCCAAGTGAGAA | 1,307,548 | 91 |
| 3547. | GCTCCCAAGTGAGAAAACTCATCG[A,G]GACACTACATGAGCGTGAGGGGGGT | 1,307,583 | 91 |
| 3548. | GCACCCTAGGAAGAATAGTGGACA[G,A]CCGCTAGATGTGCGTAGCTCTCAAA | 1,307,882 | 91 |
| 3549. | GGTATGCATGAAGACCACCATATC[T,C]TGGTGCCAGGGCCACTGTGGACAGG | 1,308,168 | 91 |
| 3550. | ACAAAGGTCAGACACCAGCACAGC[G,A]GAAGGTCAACTACTCACGAGTCTCG | 1,308,347 | 91 |
| 3551. | TGATCGAGAGCCCATCCCCCACCC[A,G]CCAAGAAGTCAGGGCCAACACCTCA | 1,308,405 | 91 |
| 3552. | GTAGTTTAGGATTCATATTTGGCA[C,T]GCATCATCGTACTCCAGGGGTTGCT | 1,308,521 | 91 |
| 3553. | TGCCAAGCGATCAGAGCCTTGTGC[T,C]GAACCACTAGGATCTTTATGCCTAG | 1,308,596 | 91 |
| 3554. | ATTGATCGGCTGACAAATAACCTT[C,T]CATGCTAGAAGATGTACCCCATTTC | 1,308,655 | 91 |
| 3555. | ACCCCATTTCCTCCATGGTGCGAA[C,T]CACATAGGAAGTTCTTGAAGAGTTG | 1,308,695 | 91 |
| 3556. | ATATTTTAAAAATCTTTTTATTTA[A,T]AATATTCAAAAATACCAATAATGTC | 1,308,925 | 91 |
| 3557. | TTTAAAATATTCAAAAATACCAAT[A,G]ATGTCAATATATTCCTAATTTGTAT | 1,308,945 | 91 |
| 3558. | TTTATTTAAAAATAGATGATTCAT[G,A]ATTCTTTTTATTTATGCTGCAATTA | 1,309,008 | 91 |
| 3559. | TGGATATAACTAATACCGGACTTG[A,T]ATCCATATTTGTATTCATTAAAAAA | 1,309,387 | 91 |
| 3560. | TGGAACCAAGGTTTTAAATCTCTT[A,G]GGACGAGACTGTTCCGATTTTTTCA | 1,310,016 | 91 |
| 3561. | TAGGACGAGACTGTTCCGATTTTT[T,C]CATGGAATGGGATGCGCCGCCGTCC | 1,310,039 | 91 |
| 3562. | ATGGGATGCGCCGCCGTCCCGTCC[C,T]GTCCTGATACTTGGAATAGAGGATG | 1,310,070 | 91 |
| 3563. | GATATCCCAATCGGGACATTGGA[T,C]GCTAGTGGGACACTGTATCCCAACA | 1,310,126 | 91 |
| 3564. | GACATTGGGATGCTAGTGGGACAC[T,C]GTATCCCAACACATGGGATGGTATC | 1,310,140 | 91 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 3565. | AATTTGGCAATTTTGCTAGTAAAA[G,A]GTCATAATATTTTTTTCAGAGACAT | 1,310,311 | 91 |
| 3566. | TTGCTAGTAAAAGGTCATAATATT[T,C]TTTTCAGAGACATGTAAAATAAAAA | 1,310,323 | 91 |
| 3567. | GATGCACCTCTTTGACACTTCATC[T,C]TGAAAAGATCTCAACTACTATGAGG | 1,310,488 | 91 |
| 3568. | CATGCACCTTTGTTTTAAAGTTCT[C,T]TATCCACTATGTTGATAGAGTGGTG | 1,310,573 | 91 |
| 3569. | AGCTAGGCCCGCAACAATTTTGGC[T,C]GGGTTCGGGCCTAAACATAGGGTCC | 1,310,817 | 91 |
| 3570. | GGGTTCGGGCCTAAACATAGGGTC[C,T]GTTTGTCTTTCGGGCCGGCTCAAGC | 1,310,842 | 91 |
| 3571. | TCTTTGGTCCAGCCCGGGCTCGGC[T,C]TGGCTCGAGCCCAAGCTCGAATTCC | 1,310,895 | 91 |
| 3572. | TCGTGCCGTGCTTGGGAGAAGCCC[T,C]TGTGCTCTATCCAAAACCCTTCAAT | 1,310,964 | 91 |
| 3573. | TCTCTTCATTCCCCGACGGCGTGC[T,A]AACCCTTTCCTTCCCCTCCCACCGC | 1,311,029 | 91 |
| 3574. | TCCCCGACGGCGTGCTAACCCTTT[C,G]CTTCCCTCCCACCGCCACCTCGTC | 1,311,038 | 91 |
| 3575. | CAGTACATGTTTTGCTTTTTCTCA[C,T]AGCCAAGGACCGTCGAACCAGAATC | 1,311,327 | 91 |
| 3576. | GTCGAACCAGAATCAGAGCTCGTG[C,T]TGGCCGGTCGGCGATACGATTCAGT | 1,311,363 | 91 |
| 3577. | GATTCAGTATGGGTCTGTACTATT[C,T]TGTGCGGGGCCGAACTGATAGGGTA | 1,311,405 | 91 |
| 3578. | GAGGGCCTCCGGCAGGTGCTCTCA[A,G]GTCCCTTGGCGTGGGCTCGTCGGTC | 1,311,505 | 91 |
| 3579. | GTGGGCTCGTCGGTCGTTGGAGAC[A,G]TCATGGTGGCAGTGCCATCCATCCG | 1,311,540 | 91 |
| 3580. | CATCCATCCGGAGGCCTTCGACGG[T,C]CTCCAGACATCCAGTAAGACTCTTC | 1,311,580 | 91 |
| 3581. | TAGCCCATTAGGAGGATACTCATG[T,C]CGTGCTTAAGAGAAGCCCCTGTGCT | 1,311,886 | 91 |
| 3582. | GCCATGCTCCTGCCGTCGTTGTTC[T,C]GCTCCCTCTCTTCTAGCCTCGCTCG | 1,312,026 | 91 |
| 3583. | ACCGGCATCTTTCTTCCCCACCTT[G,A]TTGCCGCCATGGTGTGCCCTTCCTT | 1,312,104 | 91 |
| 3584. | GGGCCTTAAATTTTAAAATATTTT[C,T]GAACCTAAGCTCGCCTTGACGTCTG | 1,312,228 | 91 |
| 3585. | CCTTAAATTTTAAAATATTTTCGA[A,G]CCTAAGCTCGCCTTGACGTCTGAAA | 1,312,231 | 91 |
| 3586. | TTTTCGAACCTAAGCTCGCCTTGA[C,A]GTCTGAAAAAATATTTCGGACCGGG | 1,312,248 | 91 |
| 3587. | ACCTATTTCCAGCCCTATTTCTCC[C,A]TGGAATAGGATGCCCCACTGTCCCA | 1,312,329 | 91 |
| 3588. | AACAAGACAGGACAGCTGGGACGC[C,T]CCTCGTCCTGCTGGGACGTCCCCTG | 1,312,650 | 91 |
| 3589. | TGCCTCTTAATACAATTTGGCTCA[C,T]TAACGTGCATACATGCTATATGTG | 1,312,770 | 91 |
| 3590. | CCTCTTTCTCTTTCTCCCCCCTTT[C,T]CCTCTCTCTTTCCCTTCCATTTTGT | 1,313,334 | 91 |
| 3591. | GATACCAACTACCTCACTAGAACC[C,A]AAAGAACCTATTGGTTGGTGCTATT | 1,313,790 | 91 |
| 3592. | TGGCAAGGTTCTAAATACTAGCCC[T,A]AATAGGACATGCCTTTACTGACATA | 1,314,210 | 91 |
| 3593. | TCTGGTGGTATACTGAACCCTGGT[G,A]CCATACCAGCACTGTGCCGACTGGC | 1,314,303 | 91 |
| 3594. | GTGGTTTCATTCTGTTGTAACTGC[C,T]GAGCTTTATTCCTTAACTGCAGCGA | 1,314,823 | 91 |
| 3595. | GAGCAGATCACACTTCAAGATACT[T,A]TGGATGGCACAGGATATTCGACATT | 1,341,901 | 91 |
| 3596. | AGAAACAAATGTTATGAACCCCAA[G,A]CTGATGCGCAAAACAAAAACAAAAA | 1,315,726 | 91 |
| 3597. | TTGTTAAATATTCCAATCTTCCTT[C,T]TTCTTGTTATTTGAACTTCAGAATA | 1,316,345 | 91 |
| 3598. | AACTTCACTGAGAAAGGAGGCACT[T,C]TATGTTACTGAATCTTCTTTTGATT | 1,317,496 | 91 |
| 3599. | AAGGACACCAGTCTTGAGGATAGG[G,A]CCGACACCGCCACCCCCAAAGCAG | 1,318,228 | 91 |
| 3600. | ATTCCCGTTTGTATGACATCCATG[T,A]ACCAGCTGTTATTGTAAAGCCTATC | 1,318,458 | 91 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 3601. | TATTGTGAATCCTGATTCTAGGAC[T,C]ATGGTCAGAAGTCATATATGTTACT | 1,319,112 | 91 |
| 3602. | TCCCCTTTGCAGTGCAATACGGCA[A,G]CAACTGATAAATGCTGAAGATATAC | 1,319,211 | 91 |
| 3603. | ATGCTTTCATTATAAAATCAACAT[G,T]GTGGTGAATTACCAAGTTCATTATT | 1,319,418 | 91 |
| 3604. | ACTTCTTTACAATAATATGCATCA[C,T]GTGGATTTCCACTTAGATCCTGTCA | 1,319,718 | 91 |
| 3605. | TACTATCTCTATATTGCTTACACA[C,T]CAAAAATCTTGTGATTTGGAGAGCT | 1,319,825 | 91 |
| 3606. | ATTTAATGCAAACATGTAAGAAGA[G,T]GCCTGTTCAAAGATCATGTGTTAAA | 1,321,390 | 89 |
| 3607. | CAGATGTTAGTAAAGATTTATACT[T,G]CTACAGAGGTATATAGGTATATGTG | 1,321,443 | 89 |
| 3608. | CTTATTTCAGCCGTAGTCAATTAA[A,T]CATAACTAACCGTGTTCTTTCCCAT | 1,321,862 | 89 |
| 3609. | CTATGAAGTTCATGCTCGCATCTT[G,A]TTATCTATATACTTTCGAGTTGTCT | 1,321,986 | 89 |
| 3610. | CCTTCATTTCTTCTTCAATTGGTT[A,C]AATTGTTATTCTTCTCCAATGTATT | 1,322,116 | 89 |
| 3611. | TTTGTGTTCTTTTCCCTGTGTTAT[G,A]AGTCATCTCTATCGATCAGAATTTG | 1,322,395 | 89 |
| 3612. | TAGTTTGAGAATTTGATCTAGTTT[G,A]ATGTTACGTTGTTAACCCTTCATGA | 1,322,453 | 89 |
| 3613. | TCAACTAATGGCAATAGATTAAAC[G,A]TGCATCCCTTTAAGGAAATTTTGGT | 1,322,946 | 89 |
| 3614. | TGATTGACGACTATATGTTCCTTA[A,C]GTTGGAAAAATAATAAGTGTACCAC | 1,322,289 | 89 |
| 3615. | TCTTAAAATTGTCTTATTGAGAAT[C,T]AAATGACAACAGAAACAGCAATTTG | 1,323,401 | 89 |
| 3616. | CTCTAAACTTCCCACACACCAAAA[A,G]TCATTTGACTTGAAGACCTTTAGCC | 1,323,586 | 89 |
| 3617. | GCATGCTCGTGATACTATTTTGTA[G,C]GCTCAAGGAACAAAGTGTTATAGGA | 1,324,584 | 89 |
| 3618. | GCTGGTCCTCCCGGACAAGGTAAC[C,T]TCCTCAACTTGTTGTTTCATTTATG | 1,324,983 | 89 |
| 3619. | TTGCAAGCAACAAAAATGTTTTTG[A,G]GTTAAATATCTCATAATCATATGTT | 1,325,302 | 89 |
| 3620. | ATCATTATAGTTATCTAATTTGCT[T,A]TGGTGAGGAAGGCCGACATGCTGCA | 1,325,506 | 89 |
| 3621. | TGCACGGAAGCATGTGTATTGCGC[T,C]GTTTCTGTTTTGTCTGTCCATGTG | 1,325,727 | 89 |
| 3622. | ATTAATTATAGAAGTTTATGATTG[T,A]GGATTTCAATGCTGATCATTATCTG | 1,326,298 | 89 |
| 3623. | GGAGAACACTAAAAGAACCAGCAT[G,A]TGCTGGAATATGTTTTTCATATAGA | 1,326,421 | 89 |
| 3624. | ATTTTAGATGCTTTATAGCACCTT[C,T]GTTGGTTTCAATCCTGCTATCAGGA | 1,326,656 | 89 |
| 3625. | TGTTGGTATTCTGTGAAGTTAACT[G,C]GTCTTCATGTTCCTTCAATCAGAAA | 1,327,172 | 89 |
| 3626. | TGCTCCTGTAAACCGCCTGACACC[G,A]GAGACTGAATCAGAAAGTTGCTTT | 1,335,468 | 89 |
| 3627. | CATATGTCTGGTATTCTAGAGAA[T,A]TTGAGTACAAATGTCAGGAGATGTA | 1,336,079 | 89 |
| 3628. | CATTGAATTAACCCATTAAATTTC[A,G]TGGATAATTGTTCTCTTTTGGCCCA | 1,336,346 | 89 |
| 3629. | GTTCCAGCTACAGAAGAAGAAGCA[C,T]GCCGGGTACTTGAGCGCATTGATGC | 1,336,478 | 89 |
| 3630. | CTGAGACAATGTTTAGTTAATTCA[T,A]AATCTAGCTATCTTCTTTAGTGAAA | 1,336,527 | 89 |
| 3631. | AATCCTTTTTTtCGTTGAGCCTC[T,G]ATAGGAAATATTCCTGGCAAGGGCC | 1,337,115 | 89 |
| 3632. | CCTGGGATTGAACCTCCGACTTCT[T,C]GTATTGCTTGTCATGTTAAGATTAC | 1,337,170 | 89 |
| 3633. | TCTTGTATTGCTTGTCATGTTAAG[A,G]TTACTTTGTATTGCTCAAGTACCTC | 1,337,191 | 89 |
| 3634. | TTCTTCTCAGGGAAAGCGTTGGTT[G,A]GTGACTGGATTCCATGCATTACCTG | 1,337,446 | 89 |
| 3635. | GGAAAGCGTTGGTTGGTGACTGGA[T,A]TCCATGCATTACCTGTGCCTAATCT | 1,337,456 | 89 |
| 3636. | GCAATCAAGCATATTTATGCTCCA[G,A]TAGCCTGGTTGGCTTCTAAACACTC | 1,337,586 | 89 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 3637. | CTTCTAAACACTCGAACAAGTATA[A,T]TCACATTTTGATTGTTTTGTGTAAT | 1,337,623 | 89 |
| 3638. | GATTTATCCGCTGCCTTCGGTGTG[A,G]TGTATCAAATTCATGAAAAATGAAT | 1,338,259 | 89 |
| 3639. | GATTTATCCGCTGCCTTCGGTGTG[A,C]AGTTACCCTATGATCAAGTCATCGA | 1,339,420 | 89 |
| 3640. | AAGTTACCCTATGATCAAGTCATC[G,A]AAAGGATCCCATCCATCATTTCTAA | 1,339,444 | 89 |
| 3641. | AATTAAAACTGTTATTAAGGCAAG[T,C]CTATCCTATATATCAAATTCATTGA | 1,339,494 | 89 |
| 3642. | ATCCTATATATCAAATTCATTGAT[A,G]GTTCATAACCTCAAATTTGCAACTA | 1,339,521 | 89 |
| 3643. | CAATAGCATGTCATAGTTATAATC[A,C]GATGGAAAATCTAAATCTACTTGTT | 1,339,603 | 89 |
| 3644. | CATAGTTGTTTTATAATGACTTGG[G,C]AGATTGTAGTTGTTTCAAGTCATCT | 1,339,776 | 89 |
| 3645. | GACTTTGTATGGTAGTGGTGGACC[T,G]CCATATAACTTTAATCAGAATGTAA | 1,339,884 | 89 |
| 3646. | CCAGGTTTTGTTTAAACGGGCCGT[A,T]CCCATTTAGTCGCGCCCGGCACGGC | 1,340,096 | 89 |
| 3647. | TTAATTTTTATATCATTGCATGTC[C,T]GGTCATGCAAGGTCAAGCCTAAAA | 1,340,371 | 89 |
| 3648. | GCAAAGGTCAAGCCTAAAAAGCAA[G,T]CCATACAGGAGCGTGCGGCCATTAG | 1,340,402 | 89 |
| 3649. | TCATTGATTTTTATGTTTCCTTT[T,C]GAATCTTTTCTATGAGGCATGCTTT | 1,340,514 | 89 |
| 3650. | ATTGATTTTTATGTTTCCTTTTG[A,C]ATCTTTTCTATGAGGCATGCTTTCT | 1,340,516 | 89 |
| 3651. | ACTCATAACAATGAGCTGCACAAC[T,G]GAAACTTGTTCCAAATTCTGCACAT | 1,340,962 | 89 |
| 3652. | TTAATGATCTCGTCCTCTGCCTTC[T,C]TTAAGAACCCACTCATAGCATCATG | 1,341,577 | 89 |
| 3653. | CCTCTGCCTTCTTTAAGAACCCAC[T,A]CATAGCATCATGAAATTGCTGGCTA | 1,341,590 | 89 |
| 3654. | ACACCCAAGGCCAGCGACAGCTTG[G,T]AGGCCAAGCTTTCTGCACTCAAGGT | 1,341,774 | 89 |
| 3655. | GCCAGCGACAGCTTGGAGGCCAAG[C,T]TTTCTGCACTCAAGGTCATCTCGTA | 1,341,783 | 89 |
| 3656. | CTGATTGAATTTTAATGATGACAA[A,T]TGCAAATTCAACAGCACTGAACTT | 1,342,238 | 89 |
| 3657. | TAGAAATGGAATGTGTGGGTGAGA[C,T]GAAAACTAGGAGGACATGGAAAGTT | 1,342,358 | 89 |
| 3658. | TTTGCAATTCAAATAGGATATTGT[G,A]AAATTTATTCTCATAATCAAGTGTA | 1,342,480 | 89 |
| 3659. | GTGAAATTTATTCTCATAATCAAG[T,G]GTAAAGTTGTTGATATtCTTTTTTA | 1,342,502 | 89 |
| 3660. | ACTCAAATGTACTTGAACATTTTG[T,C]CGATTGTTCAAATTATGAAAGAAAG | 1,343,291 | 89 |
| 3661. | CTGTCTTTAGTAAATAAGCCATGA[A,C]CGCTGCATGATATATGACATTACTT | 1,343,454 | 89 |
| 3662. | GTCACATGGAAGAATTGCAAAGTA[C,T]ATACATAAATAAAAATTTGCCATAC | 1,343,547 | 89 |
| 3663. | GGAAGAATTGCAAAGTACATACAT[A,C]AATAAAAATTTGCCATAGTATCATA | 1,343,554 | 89 |
| 3664. | TTTAAACCACTACTTTATCTACTA[T,C]TTTACTAGTGATTGACATGCGATAG | 1,343,741 | 89 |
| 3665. | ACTATTTTACTAGTGATTGACATG[C,T]GATAGTTCACTTTTTTCCTATCCAG | 1,343,761 | 89 |
| 3666. | TAGTGATTGACATGCGATAGTTCA[C,T]TTTTTTCCTATCCAGAATAGAATTG | 1,343,771 | 89 |
| 3667. | TAGATTTACCTCAAGAGTTTCAAA[C,T]GATTTCTTAAGATAATTGACCTCTG | 1,343,841 | 89 |
| 3668. | CGCATCCACTCTCTTAAAAGCAAA[C,T]GGTATATCAAGCACTGCCTTGAGAA | 1,343,916 | 89 |
| 3669. | AATCAACCACAAAAATACCAGTAA[A,G]AATAACTTCATTTGAGTTAAAATTG | 1,344,115 | 89 |
| 3670. | AATCAACCACAAAAATACCAGTAA[A,G]AATAACTTCATTTGAGTTAAAATTG | 1,344,129 | 89 |
| 3671. | ATACAGAAGACTTCAACAACTGAA[T,G]GGGCTAAAACAAATGGTTCAGAAAAT | 1,344,181 | 89 |
| 3672. | GATACTTGATATTGCATTTCATTA[T,A]GCATGACCAAAAAAAGAAGATTAA | 1,344,367 | 89 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 3673. | TGCATGACCAAAAAAAGAAAGATT[A,G]AACAGCTACAATTGATACATGACAG | 1,341,391 | 89 |
| 3674. | GCATATAGATTGCTACCGAACAGC[T,A]TTTTTATTTTACTATCATTTTGACT | 1,344,673 | 89 |
| 3675. | ACAAAACTCTAGTTAATATCTTGC[G,T]GCCATTGGGATTAGGAAGCTCACCG | 1,345,087 | 89 |
| 3676. | CTTGCGGCCATTGGGATTAGGAAG[C,T]TCACCGAAACAAAAGAAGCAAACTG | 1,345,106 | 89 |
| 3677. | AGGCCAACAAAGAAAGAACACCTA[A,T]CCCTTGGCTAAAATATAGAACAATA | 1,345,201 | 89 |
| 3678. | ACCTAACCCTTGGCTAAAATATAG[A,G]ACAATAACCTTTTTGGAGGCAAGTG | 1,345,220 | 89 |
| 3679. | GCAAAGGGGACAGATGGTTACATG[T,C]AAACTCCAAAGCACCATACCTCACC | 1,345,270 | 89 |
| 3680. | ATCTATTTTCCAACATACACCGAG[A,G]TTGAGGGAGAGTTTATACGTGAATA | 1345,419 | 89 |
| 3681. | CAGTTCATAACGGTGATCAAATCT[G,A]ATTAGGAAAAAATGAGCACTGGCGT | 1,345,557 | 89 |
| 3682. | AAGCATTTTTATCACAATATTGGT[A,C]ATAAAGTTCAAAAAGAGAAAGAGAT | 1,345,910 | 89 |
| 3683. | GGAGAATAACAGCAGGAAGAGAAG[C,G]AAGAAGAAGGAAGGGACTGGCATAT | 1,347,534 | 89 |
| 3684. | TTCTTTTCTTTTCTTCTCCATTTT[C,T]CCTTTTTTTTTTtGTTGCCTCCT | 1,347,691 | 89 |
| 3685. | AAGGAGACGAGAAGATCATAGTAG[C,T]AGAGCAAGACTAAAACAATTAATTA | 1,347,767 | 89 |
| 3686. | AAGGCCGAGAAAACATTGTCGGCC[G,A]GAGAGAACAAAAATGTGGCGGAGAT | 1,352,528 | 89 |
| 3687. | ATATAGATATATTGATATTTATTT[C,T]GTATTTGATCTATTTTTGATCTCAA | 1,353,125 | 89 |
| 3688. | CAATGTACTTATTTTAAATTGGTA[C,T]GAGCGGCTGTTTGTATAGAAGAAAA | 1,353,172 | 89 |
| 3689. | TACTTATTTTAAATTGGTACGAGC[G,C]GCTGTTTGTATAGAAGAAAAAAATT | 1,353,177 | 89 |
| 3690. | CCCCGCGTCTGGATCTCTGGGAAA[C,G]GACAAGAGAAACGGGAAAGCGGAAG | 1,353,391 | 89 |
| 3691. | CGTGAAACGGGAATCGCGGCCTGG[A,G]GTGGTTGCAGCATGTGCGCGCCCCA | 1,353,460 | 89 |
| 3692. | GATTCTCCTGGGAGGTTCCAGGGG[A,G]GCGACGTCAGCGGGTCTGCGAGGCG | 1,353,528 | 89 |
| 3693. | TGGTTGGATAGATATCAAGTCCAC[A,C]GACCAGTGAGATTTTTTTTTTTt | 1,353,808 | 89 |
| 3694. | AAGTATCATTCTATTCTTCTCTCT[C,A]TTGCTTGATCTGGTATAATACCCGA | 1,354,139 | 89 |
| 3695. | TATCATTCTATTCTTCTCTCTCTT[G,A]CTTGATCTGGTATAATACCCGATGA | 1,354,142 | 89 |
| 3696. | TTTAACACATTTGAAGAAAAATTT[A,G]CATTTAGAAGTTCCATGTTAAGATA | 1,354,318 | 89 |
| 3697. | AAGATAATCGATGGCAATTCATGG[C,T]GTATGGCCTTAATTAAAATGAGTGT | 1,354,362 | 89 |
| 3698. | ACCAAGTAACTTCCTTGATTTTGC[A,C]TCTTCTTTCATTGTGGTAGTACCCA | 1,354,891 | 89 |
| 3699. | ACCAAGTAACTTCCTTGATTTTGC[T,C]AGGTGGTCTAAGATAATTAAAGGTC | 1,354,943 | 89 |
| 3700. | TATATTGGTTGGGTGATTTACACA[C,T]GATGAGCCATTTTTTAAGAGGAAGA | 1,354,003 | 89 |
| 3701. | TGAGGTGATAAATGCAGTATATAT[G,A]AAGATCAATTGCGGTGATAGCACTT | 1,355,097 | 89 |
| 3702. | GCAGTATATATGAAGATCAATTGC[G,A]GTGATAGCACTTACATACAACATCT | 1,355,110 | 89 |
| 3703. | TCCTCATACTGATATTCTTTTTCC[C,T]GTTGAATGCATGAAACTATTGGTTT | 1,355,165 | 89 |
| 3704. | CAAATCAAAATTTTATATAATAGA[A,G]ATTTTATATCAATGATCCAAATTAT | 1,355,290 | 89 |
| 3705. | TTATTGAATACAATCTACCATCTC[A,C]AAATTACTTACACATAAAATATCAT | 1,355,336 | 89 |
| 3706. | ATGTATCAAATAGTAAAAAATTGA[G,A]TAGTCTAAATAAAATTGAATTATAT | 1,355,408 | 89 |
| 3707. | ATTTTTAGATTATGATAAGTTAGA[G,A]ATTTTCAGATCATATGATTTTTGAT | 1,355,460 | 89 |
| 3708. | ATTTTTGATATGTAAGTAGTTTTG[A,C]GACAGTAGGTTACATTCAATGACTT | 1,355,501 | 89 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 3709. | GAAAGTTAAAAATTTTCTGGCCAA[T,C]TTATTTCTGTTTGTTGATTTTTAA | 1,355,654 | 89 |
| 3710. | TTTGTTGATTTTTTAAAATAAAAA[A,G]TAATATGATCAGGTAGGTCTTAAAT | 1,355,688 | 89 |
| 3711. | ATCAGGTAGGTCTTAAATCTAAAC[A,T]TCACGTTGCTGTTAGATTCTAATTT | 1,355,720 | 89 |
| 3712. | AATTTAATGATCCAATCTTTTCTC[T,G]GGAGCTTCTTATTTTATTGCATGGA | 1,355,765 | 89 |
| 3713. | AACCGCCATTAACAATGCAAGAAA[G,T]GTATCATTTTTATATTATTATTACT | 1,355,887 | 89 |
| 3714. | TTACTGGTCGTAATCTATTTGTTT[G,A]CATGTTTGTTTAATCTTTTATGGAC | 1,355,932 | 89 |
| 3715. | CCAGTGCGAATATGTTTGAGTTTC[T,C]GGGGGACATTAATAATTATTATGAT | 1,356,053 | 89 |
| 3716. | ATATTATAAAATATTAATTTGAAT[T,C]TAATTTATTAAATTAATTTAAATTA | 1,356,356 | 89 |
| 3717. | CAAGAGAGAAAGTCTCTGTACACC[A,G]TAATAAAGTTGACGTAAAACGTATC | 1,356,771 | 89 |
| 3718. | TTAATATCATTATCATCTTTATCA[T,C]TAGCTATTTAAGTAATATAAATAAA | 1,357,494 | 89 |
| 3719. | TATCATTATCATCTTTATCATTAG[C,T]TATTTAAGTAATATAAATAAAATTA | 1,357,498 | 89 |
| 3720. | GTAGGGGACAGGGAATGGATGCTA[G,A]CAAAAGATCTCTTTCCTTCTGGAAA | 1,357,630 | 89 |
| 3721. | CTAGCAAAAGATCTCTTTCCTTCT[G,A]GAAAAATTAATCCACTTTCACACGT | 1,357,651 | 89 |
| 3722. | CATTAAAATTGATATCCATATCTC[C,T]CAAGTTACTACTCCTCTGTCTAAAA | 1,357,725 | 89 |
| 3723. | AAATTGATATCCATATCTCCCAAG[T,A]TACTACTCCTCTGTCTAAAATCATT | 1,357,730 | 89 |
| 3724. | GCAGGTAGATGGGGATGCAGGGGT[G,A]GGGACAAAATATTATGATGTTGCAA | 1,358,232 | 89 |
| 3725. | TCAATTCTGAATTTTTAATGATAA[C,G]AGCTCAATCATGGGCTCCAAGAACA | 1,358,469 | 89 |
| 3726. | GGAAATATGGTAGAATCTTATAGC[T,A]AAGGAGCTTTGCTGACAATCTAAGA | 1,358,564 | 89 |
| 3727. | TCTTATAGCTAAGGAGCTTTGCTG[A,G]CAATCTAAGAAGAAGGTTGAGTAGT | 1,358,579 | 89 |
| 3728. | TTGAGTAGTGATGGAAGGCAAAGG[G,A]CCCTGCAAATAGGCAAGAGTAATTT | 1,358,620 | 89 |
| 3729. | TAGTGATGGAAGGCAAAGGGCCCT[G,A]CAAATAGGCAAGAGTAATTTTATTC | 1,358,625 | 89 |
| 3730. | GCAAGAGTAATTTTATTCTAAACA[G,T]GTAAATAATTACAGATACACAAGGC | 1,358,657 | 89 |
| 3731. | TTTCATGTTTGGGGAAAAAATTCT[A,T]GTACTGAAATTATCTAAACTAACTT | 1,358,899 | 89 |
| 3732. | TCTTACTTAAAACTAGTCTCTCTT[G,A]GAAAAGAAAAAAaTCCTACTTAAAT | 1,359,028 | 89 |
| 3733. | GCCATGAAGCCCAATTTATGCTTA[A,G]GGGCCTCCATATAGATATGTTGACA | 1,359,133 | 89 |
| 3734. | GCCAACACATTTATTATTTACAAA[G,A]GAGAAAATATAGCTCAGCACCCGTT | 1,359,214 | 89 |
| 3735. | CATTGCGCATGGATTCTATGTCAG[G,C]TAATTGATCATTTGTTTAAGAAaAA | 1,359,291 | 89 |
| 3736. | ATTTATACTTGTAAATGAGCTTCA[T,A]TGCCATTCTTTAACCGTACAATGCT | 1,359,410 | 89 |
| 3737. | AAGTGAGCTTTAAAACTATCCTTT[A,C]ATAACATAATGTTTTCGCTTTTAGC | 1,359,476 | 89 |
| 3738. | TTCGCTTTTAGCTAGTATGGTATT[G,A]TAGGTTGATTTTGATCTAAATGGTA | 1,359,514 | 89 |
| 3739. | GTGAGAATGTATTGTTTATGTAGA[T,C]AACTTAACTTGCTAATGAATTTtTT | 1,359,571 | 89 |
| 3740. | GCATGGAGTAAATCAATTATATCG[G,A]TCTATGATTTAAAATAAATATTAAA | 1,359,842 | 89 |
| 3741. | AGAGAATTATAAAAAAaTAATTAT[A,G]AAAAaTATTAAAAAaTATATAAATT | 1,359,907 | 89 |
| 3742. | ACAAATAATCTCTATTCTAATTTT[C,T]TTCTTATGTCTCTCGTACACTTTTA | 1,360,018 | 89 |
| 3743. | GTCTCTCGTACACTTTTACATCCA[A,G]AGAAAACTCTAATGATTCTTTTAAA | 1,360,050 | 89 |
| 3744. | ACTCTAATGATTCTTTTAAATAGA[A,G]CATTATATAGATGAAAGTTTAACTC | 1,360,080 | 89 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 3745. | TAAAAAATTAAAAaTTTATTAAAA[T,C]ATAAATTTTAATAATTTTTAGAAGG | 1,360,140 | 89 |
| 3746. | AAATAATTAAATGGAGTAACATTG[G,A]AAATAGAATCTTAAAGTTATTAAAA | 1,360,190 | 89 |
| 3747. | AAAACTAATCATCAACTAAAAATA[A,G]AATTCTAAATGAATTGAGACTTGTT | 1,360,236 | 89 |
| 3748. | GTGCTGGAAAATCTGAACCTAATT[A,G]GTGGTTAATATCTCAATTCAAATTT | 1,360,316 | 89 |
| 3749. | ATTTTtAATTTTTTTtAAGGGTAA[G,T]AACCCACAGGCATGTTTAAAGCGAA | 1,360,494 | 89 |
| 3750. | CTACTGGAGATCGGGAAACACAGA[A,T]GAGTTCATGTTCATTTCTAAATTTC | 1,360,550 | 89 |
| 3751. | TTATAACACCAAATGGAGCAATCA[T,A]GTTTAGTTGATGTATATATACAACA | 1,360,718 | 89 |
| 3752. | CTTAATTAGCATTCTTTTGTAGAA[A,G]ATGGGCAATGACTGCTTCATGATGG | 1,360,863 | 89 |
| 3753. | TGACTGCTTCATGATGGAAAATGT[G,A]GCTGTTATTGATCCTTTTATTGTTC | 1,360,896 | 89 |
| 3754. | GCTGCTTTACGGATGGATTTGTCC[G,A]TCGGCTCAACAATGAATAATTAATA | 1,361,166 | 89 |
| 3755. | ATTACAATAATAAATAAAAAaTTT[A,G]TGATAAAATTATCATTAGAATCTAC | 1,361,256 | 89 |
| 3756. | AAAAaTTTATGATAAAATTATCAT[T,G]AGAATCTACATGAATCTCTAGGCCC | 1,361,272 | 89 |
| 3757. | TCTCTAGGCCCTTCAGCTGTTCAT[A,G]ACCATGCAAAAACTCCACTAATTAG | 1,361,311 | 89 |
| 3758. | TCTAGGCCCTTCAGCTGTTCATAA[C,G]CATGCAAAAACTCCACTAATTAGCT | 1,361,313 | 89 |
| 3759. | CACTGAGATTATATAAGAAAAATT[G,A]GAATTATATAAACTTGTACTATTAA | 1,361,413 | 89 |
| 3760. | AAGGGAAGTGTGACTTGCCTTTCC[C,T]TCTCCTTTTTCTTTACTCTTTAATA | 1,361,589 | 89 |
| 3761. | GATTCCTGGGCCAGTGAATTATGA[A,T]GCTTTGCATGAACTATAAATGATCC | 1,361,689 | 89 |
| 3762. | TCCCTTGCTAAAACTTTTGGCACA[A,G]GTAGAAAAGCTCTAAAACCTCACAT | 1,362,199 | 89 |
| 3763. | CGAATTTATAATAAAACAACAACT[A,C]AATTACAACTTAATTTAAATATTGG | 1,362,537 | 89 |
| 3764. | TCCACTACGAACAGAACGCATGTT[A,T]TGTGATGCTTGTCTCATGGGTCACT | 1,362,88 | 89 |
| 3765. | TAGGAAGGAAAAAAGATAGCACTT[A,C]CATACTGCTCCATACTCCTTTTGTT | 1,363,074 | 89 |
| 3766. | TTCGGTTTTATCACAAGAGGAAG[G,C]AATGAAAAGCAGTACTTTTGGATGT | 1,364,985 | 89 |
| 3767. | TGTCAAGTGTCAAGATTAAAGAAA[C,T]TTTTAGACTATGATGAGCATCACCT | 1,365,064 | 89 |
| 3768. | AAATGGAGGGGAAAATCATCAATA[A,G]TACACATAAAGTGTTATGATCTCCA | 1,365,405 | 89 |
| 3769. | CCATTTTTTCGATAAAACTATGA[A,C]ACTTATTCACCGTCGACTTTATTAA | 1,365,452 | 89 |
| 3770. | AATATTTTACAATTTAATATCATT[A,G]ACGAAATTCAATCATTAGCCTCTTT | 1,365,541 | 89 |
| 3771. | TTCATATTGGCAATTGATTCTTTC[G,C]TGGGCCAACCTGATTCCCCACCCAA | 1,366,194 | 89 |
| 3772. | GGCCAACCTGATTCCCCACCCAAT[T,A]GTTTAAACCAATTGTTGTGCCCTAT | 1,366,221 | 89 |
| 3773. | CTCAACCAATGGGCTAGCACCAGC[C,A]ACAGCAGTAGATAATGTCCCAAACT | 1,366,431 | 89 |
| 3774. | TTAGGCCATTGTTTCAGAGTACAC[A,C]AATTTACACACAAGGGAGCAGAATG | 1,367,082 | 89 |
| 3775. | TTTCATGAAACATTTATATGAAGA[A,T]ACGGCTGTCTAGGTACAACTGAGGT | 1,367,504 | 89 |
| 3776. | TGGCAAATAGGCCATCACACGACT[A,G]TGGTAGGTAGGTCGAATTAGGAGAT | 1,367,617 | 89 |
| 3777. | CTTGGTCCCAAAATTCATGGCAAA[T,C]CATCCAAATTACTATTCCAATGGGC | 1,367,791 | 89 |
| 3778. | CATATGGCCTTTCATCATTTTGAG[C,T]ATTTTCTGTCACCTAGTATATATTA | 1,368,071 | 89 |
| 3779. | CAACTAATGTTATCAAAGTTTCCA[G,T]GTCAATTGCAACATCCGTTTGTGT | 1,371,479 | 89 |
| 3780. | ACCGCAATGCAGAAAGAAAGCATA[T,C]AGGTGAATTGGGTGCACCTGCATGT | 1,371,536 | 89 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 3781. | GGTGCACCTGCATGTCCTCATGTG[G,A]AAGATATCATTGTCCAACAATAAAA | 1,371,571 | 89 |
| 3782. | AATAATAATGCCTAATGAACTTGT[A,G]CATTTTCATTTGCTAGCCCTTTGGA | 1,371,967 | 89 |
| 3783. | CATGCTGCAAATAGGAAACGATGA[T,C]TGAGGTTCTTTGGAGTTTAGAGTTG | 1,372,170 | 89 |
| 3784. | TTCTGAGAATGGCAGTCCTTAATT[C,T]GATGGCCTCATGAATCGAAGGTCAT | 1,373,513 | 89 |
| 3785. | AATATGTAGAGAGCAAATAATGC[T,C]ACCATGCTTGCCATTTTATTGTTTC | 1,374,208 | 89 |
| 3786. | TGTGGGATGGAGAATGAGATTGCT[T,G]CACAATCTTCATCATGACTTCACAA | 1,374,261 | 89 |
| 3787. | ATGACTTCACAAGGAAAATCTGGT[G,T]GCATATTACTGAGATATTGTCATTT | 1,374,299 | 89 |
| 3788. | TAATCACAGAAACATGCTCTAATA[G,A]TGATTATTCTATGAGCTCTCTATTT | 1,374,645 | 89 |
| 3789. | TTTGCCAGCATGGCACGTACTGTG[C,T]GATGCATTGACATACAACATGCACC | 1,375,874 | 89 |
| 3790. | ATTTTTCCAGGTTTTATTTTTTTT[A,T]AACTTTGACATTTGAACTTCGTCCT | 1,375,985 | 89 |
| 3791. | GACATTTGAACTTCGTCCTAGTCC[G,A]GTTAAGAGTTGCTCACAAAATTAAA | 1,376,016 | 89 |
| 3792. | CAAGTTAAACTTATTTTGATGAAA[C,T]TTGAAACGTTGACCATTTCTATCAA | 1,376,663 | 89 |
| 3793. | TAGGAAAAGCAACTTATCAATAAC[A,G]AGCATAAGAGGAAAGAAGTTCTAAC | 1,377,079 | 89 |
| 3794. | TCTATTTTTCAAACTCATCATATG[C,A]TAAGGTTGATTGATCACATGACCAT | 1,377,213 | 89 |
| 3795. | GATCAGTGTCACCAAAAGAATGTC[G,A]AGTTCAAATTTGTGCAGGCAGATA | 1,377,376 | 89 |
| 3796. | TAAAGAGTGGGCCTTGGTGCAACA[A,G]TTTGGTTGCTTCATTATGACATGGG | 1,377,619 | 89 |
| 3797. | AAGAAAAGTAAACTAAAGGCAAAC[C,A]ACACTTATCTCTATCTAAACTTAAT | 1,377,799 | 89 |
| 3798. | CATGTAATCAGTATGAATAGATTA[C,T]CACAAAATCTGAAGTTTTAATGAAC | 1,378,234 | 89 |
| 3799. | TTATTTGTCAGAGTTATGATGAAA[G,C]CATGGAAAATGTAGCTAAAATTTAG | 1,378,409 | 89 |
| 3800. | TCAGAACACGTAAATGTAGGTTTT[G,T]CTGGATATATTTGAAGGCACCAAGC | 1,378,949 | 89 |
| 3801. | TCTTTGTTCCTAATCCATCTGCAA[T,A]AATGATAAAAGTACATAACTAATTC | 1,379,070 | 89 |
| 3802. | CTTTGAGCACTTGCTTACCTTGCC[A,G]ATTAACATTACATCACCAATAAAAT | 1,380,653 | 89 |
| 3803. | TTACATTATTTAAGATAAGGGATA[G,A]AATAGCCAAATTATTTGCATATATG | 1,380,951 | 89 |
| 3804. | AGCAGACTAATTATCACTAATACA[T,A]CATCCAATCATTCATATGTCCATCC | 1,381,031 | 89 |
| 3805. | CCAAATTGTTTAGTTTACTCTGTC[G,A]GCAGTAACCCTAAAATGGTAGCTCA | 1,382,247 | 89 |
| 3806. | ATTGATAAGAAACCCAACTGAAAC[C,T]GGGGTTCCAATTGTTCAAAATTATT | 1,382,297 | 89 |
| 3807. | CAACTGAAACCGGGGTTCCAATTG[T,C]TCAAAATTATTTTCCTAATACAAAA | 1,382,311 | 89 |
| 3808. | GATATGTTAGAGGCAACAAATGGG[C,T]CTATTTACACCGAATTATCATGGCC | 1,382,671 | 89 |
| 3809. | TAAGTTCCATTTTTTAAAAAAAa[C,T]ACTTTAGATTAAATCAAGATGTTTG | 1,382,798 | 89 |
| 3810. | TAAAAAAaCACTTTAGATTAAAT[C,A]AAGATGTTTGAGGATTGAAGTCATT | 1,382,813 | 89 |
| 3811. | AAATATATCTCTTCTTTCTGTTTT[G,C]TCGAGACATGGTCTAAAAATCAGAT | 1,383,026 | 89 |
| 3812. | AAGAAGGAACAAGGGAAAAAAGAA[C,A]AAGGAGGAAAGAAAGGAAGGGAAAA | 1,386,486 | 89 |
| 3813. | CGTTAAAGAGATGGAGGGTACCTA[T,C]GGGACAGGATAGAATAGCGGGCAT | 1,386,588 | 89 |
| 3814. | TCCCGTAACTTTCAACAAATAAAG[T,C]GAAATAATATATTGGTGAAAATGATA | 1,389,152 | 89 |
| 3815. | GTAACTTTCAACAAATAAAGTGAA[T,C]AATATATTGGTGAAAATGATATGAG | 1,389,156 | 89 |
| 3816. | AAAATGATATGAGATTGTTAGTTG[T,C]CAATTACAGTTGGTCTTGGAATTGA | 1,389,193 | 89 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 3817. | TCATGACTCTATTTCTGCATTTCA[G,A]GAGAGGAAATGAGAGGATTAGATGT | 1,389,764 | 89 |
| 3818. | TTGATTTGAAGCATTCATATTTTG[G,C]GATCATGGTGTTTGTGGGGCTTTA | 1,389,940 | 89 |
| 3819. | CTTTACCTATCAAAGCTACATCCC[A,G]TGTTGATTTTAAGCATACATGGTTT | 1,389,985 | 89 |
| 3820. | TTAAGCATACATGGTTTGGCATTA[T,C]ATGTTACACATCACAGTGTTTGTGT | 1,390,018 | 89 |
| 3821. | GTACACTTTACATATCAAAGCTAC[C,A]TACTCTGTTGATTGTATGCATACTT | 1,390,139 | 89 |
| 3822. | ATAATAAAAATTAAACCTTATCA[A,G]CTAGTATGCATTATATGTTACATAT | 1,390,220 | 89 |
| 3823. | CCCCGTCACCCCTCTCTTTACCAC[G,A]TCTCTGGTCCCCTCTTTCTCCCAT | 1,391,647 | 89 |
| 3824. | CGTTTTCTCGAGCCCCCGATCGTT[C,G]GATCCCATCTTTCAGAGCCCCCAAC | 1,391,737 | 89 |
| 3825. | ACTTGCAATGCCTTATTTTCCAAT[A,G]GCAGATTTGAGCCTTTTTCTTTTCC | 1,393,454 | 89 |
| 3826. | TTTTtATTTtATTTTTtAAAAAAA[T,A]TTTCAATGGATTCGGGTCAAGCTTG | 1,393,554 | 89 |
| 3827. | CATCACAGTAGGTAAGTTAAGTAG[T,C]TGAGCTCGTTGTCGCTCATTCAGCT | 1,393,970 | 89 |
| 3828. | TAATTAGGTTTAAGTCAGAAGAAG[G,A]AGATATAGAGGTCAAATCAATCTT | 1,394,048 | 89 |
| 3829. | TGATGTCGGGGTTGATAGGGAGGT[T,C]AACGGGCTCCCACTCAAAAAGGGCA | 1,394,970 | 89 |
| 3830. | CGGGCTCCCACTCAAAAAGGGCAG[T,G]CTCGCCAACCTCGCCGACGGCAGCT | 1,394,997 | 89 |
| 3831. | AGGGCCGGCTCATCGGACCTCGTC[G,A]ATGGTGGCTGGGGGCCGATGAGGGG | 1,395,192 | 89 |
| 3832. | CATCGGACCTCGTCGATGGTGGCT[G,A]GGGGCCGATGAGGGGGGCTAGCGCG | 1,395,202 | 89 |
| 3833. | GCCAGAATATCTCAGCTCAGCTCG[G,A]CTCATTTTTAGGGCTACATGGGTTG | 1,395,555 | 89 |
| 3834. | CAATCGAGGAGAGAGCTCTCAAGC[T,C]GCCAACTCGCATTCTTCTGCACTAT | 1,395,642 | 89 |
| 3835. | AGAGAGCTCTCAAGCTGCCAACTC[G,A]CATTCTTCTGCACTATACGTATTAC | 1,395,651 | 89 |
| 3836. | GATGTGGAGTCACCAGTGACCCCA[C,T]AGTCACACAAAGCCGCATCCGACTC | 1,395,783 | 89 |
| 3837. | AAAGCCGCATCCGACTCTCAGAGT[C,T]AGATGCATGGTAGAGGATCTGTCCG | 1,395,816 | 89 |
| 3838. | GGATCTGTCCGGCTCGCGGCACCT[T,C]CAACTCGATCGGAGGATAAACAGCT | 1,395,855 | 89 |
| 3839. | TCACTTTAAAGTCTAACATTTATT[G,A]TTCAAAATAAATTTTGCAGCGCATT | 1,395,966 | 89 |
| 3840. | GCTAGTGAATGAGTTCTCCAGTAA[G,A]CCATTGGGGCTCGTGATGCAGCCT | 1,396,073 | 89 |
| 3841. | TTCTCCAGTTAGCCATTGGGGGCT[C,T]GTGATGCAGCCTTAGAGATATTCCT | 1,396,086 | 89 |
| 3842. | TCGTGATGCAGCCTTAGAGATATT[C,T]CTGATAAATCAAAAATATTTAATTT | 1,396,109 | 89 |
| 3843. | CCACACATCAGTTTAAAAGAATTG[A,G]TGATTACTTAGATCCTCATTCTCGA | 1,396,675 | 89 |
| 3844. | CTCAATGATCCAGACGTGGGTTGA[C,G]GCACATGATGGCAGTAGCGACAAAA | 1,397,051 | 89 |
| 3845. | AAGCTAAGAGGAAATAATTCAAAT[A,T]TAGAAAGAGTGGAGACAATACATAA | 1,397,503 | 89 |
| 3846. | AATTGGCCAGTTTGACGTAATTCG[A,G]CTAACCTTGCTTATGTATGCAAGAA | 1,397,610 | 89 |
| 3847. | CTACTTACCAGCTGCAAATGCAAA[T,A]TTTTAAACTATGTAGAAATGATATA | 1,397,664 | 89 |
| 3848. | ATAAAATTTTGAAATTGTTTGTTG[T,C]GACAATTAATGAGCATTGCTTTGGT | 1,397,762 | 89 |
| 3849. | AATAGAAATCTCTATTGATAATTT[G,T]GTTCATCAATTACAACAATGACCTC | 1,397,820 | 89 |
| 3850. | AAGAAAAAGTTTCATGCCTTATAT[G,A]ATTTCAGCATTTATTTCTTGCTCTT | 1,397,898 | 89 |
| 3851. | ATAACCATAGAATATGTGCCATAT[A,G]TGCCATCATCATGTTTGTTTTAGCA | 1,397,973 | 89 |
| 3852. | ACATATATTATTTTTATTTATTT[A,G]TCGAGGTAAATATATACATCACATT | 1,398,143 | 89 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 3853. | TATATTATTTTTATTTATTTGTC[G,A]AGGTAAATATATACATCACATTTTC | 1,398,146 | 89 |
| 3854. | CTTCATCTAATAATTAAATTAAGA[C,T]CTGCACTCTTTGATTGTCACATTAT | 1,398,258 | 89 |
| 3855. | ATTAAGACCTGCACTCTTTGATTG[T,A]CACATTATTATTGCTTTATTATAGT | 1,398,275 | 89 |
| 3856. | TATCATCCTTAAAATAGCTAAAAT[C,T]TTTTATGCTCGTGGGATGTGAACAT | 1,398,467 | 89 |
| 3857. | TCCATGCCGATAGACCATTCCTTA[A,G]ATATGAATTAGAAAAATCTTTATAC | 1,398,747 | 89 |
| 3858. | TGAATTAGAAAAATCTTTATACCG[C,T]CGTAGAAAAGATATGCTTCCAATTA | 1,398,775 | 89 |
| 3859. | AATTAGAAAAATCTTTATACCGCC[G,A]TAGAAAAGATATGCTTCCAATTAAG | 1,398,777 | 89 |
| 3860. | ATATCAACATATTTAGTTTATCTT[C,T]ATATCGTATCAACATAGACAAAATG | 1,398,899 | 89 |
| 3861. | GTGGATAGAATGTTGATTGTATGT[A,G]TTTGATGTGTATAATATTGAAATTC | 1,398,971 | 89 |
| 3862. | AAaTAAAAATTTGGTAGATGATTG[G,A]AATTGTATGGATGCCAGGGCGCTGG | 1,399,596 | 89 |
| 3863. | ACTTGAAATTATACAATTTTAAGT[A,G]GTCGCACCCATGTTTTCACCCTTTT | 1,399,867 | 89 |
| 3864. | TTAAGTAGTCGCACCCATGTTTTC[A,C]CCCTTTTTTATGGCTCTACCCACGT | 1,399,885 | 89 |
| 3865. | TTTCCGGATCCTGCGATGCGAAAG[T,C]ATATTCCCTCGCATGAGTCCACGGC | 1,399,937 | 89 |
| 3866. | TCGCATGAGTCCACGGCTCACCAT[G,A]TTAACTCCATCTCCGGGTTTCCAGA | 1,399,970 | 89 |
| 3867. | AACCGAAAGTTCCACCTAGCGTCC[G,C]CATACAACTTGTATGCGCTCTCTCC | 1,400,038 | 89 |
| 3868. | CCCGACAATTATAAGATTCCCCAG[T,A]TGGAAAGGGGAAAGGAGAGAGAGAG | 1,400,192 | 89 |
| 3869. | TTTCTGTCTCCGATCCCCTCCCTT[T,C]TCTTCTGGCGTTCTTTTGATTCTCT | 1,400,450 | 89 |
| 3870. | TGGATCTAATTCGGTCCGATTTGG[A,T]ATTCTATCTGGAATTCTAATGAATC | 1,400,513 | 89 |
| 3871. | TTTTGAAGGATTTATATGCAGTTT[G,C]GGTGCTTAATTCGTTCTTGACATGA | 1,400,788 | 89 |
| 3872. | GAAGACAGGAGGTGACAACCATGG[A,T]GGTTTTTAAGAAAAAAATGGAATTA | 1,400,994 | 89 |
| 3873. | TGCAACAACAATAGAATTATGCTT[C,A]GGGTTTGTTTGGTTGGGGTATGTCA | 1,401,056 | 89 |
| 3874. | ATGTCAGATTACGAGGTAATCTGA[T,C]GATTTCTGAAAATTATTTATCCGGA | 1,401,100 | 89 |
| 3875. | ATGATTTCTGAAAATTATTTATCC[G,A]GAAAAATTATTGTGGAAAATAAAAT | 1,401,123 | 89 |
| 3876. | ATTTACCACATTTGGATGGTGGAA[T,A]ACTAGCTCTGAAAAATGGCATTGGA | 1,401,171 | 89 |
| 3877. | TTTATTGGAGGTAATCTTATATCG[A,G]AATATTGTCAAATTTTCAATAATAC | 1,401,233 | 89 |
| 3878. | ATACCTGTAAATGGATAATTCAAG[G,T]AATAGCATTTTCTCAATCCATTTG | 1,401,279 | 89 |
| 3879. | TTTAATTTTTtATAAATTAATTA[T,G]ACATATATTAGAGAATATATTGTAT | 1,401,427 | 89 |
| 3880. | TTTATTATAAATAAATTTCAGTAT[G,T]CTTTGTAATATAAATAAATATATTA | 1,401,498 | 89 |
| 3881. | GTATAAATATATTAATATGTTAAA[T,C]ATATTATTATTTATATAATAATTAA | 1,401,626 | 89 |
| 3882. | ATGTATTTATAATATTAATATAAT[C,T]AATATTAATTAAATCATCTAATTA | 1,401,686 | 89 |
| 3883. | CATAATAGATTACCCCCAACCAAA[G,A]GTACCCCAAGTAGAGGAATAATTAG | 1,401,960 | 89 |
| 3884. | ACCCCAAGTAGAGGAATAATTAGC[G,T]AATAAGGATTCATAAAGCTATTGTT | 1,401,987 | 89 |
| 3885. | CTTTTCCACTAATTGAATAAGTTT[T,C]TCCCTTTTCCCCACTTCTCCTACC | 1,402,177 | 89 |
| 3886. | TTTTCCACTAATTGAATAAGTTTT[T,C]CCCTTTTCCCCCACTTCTCCTACCT | 1,402,178 | 89 |
| 3887. | TCTTTTATTTAATTATTTGGTTTG[T,A]TATTGTTTGCAATAAATTAAGTTTG | 1,402,278 | 89 |
| 3888. | TGAATTGCTTTATATGGTTTTCTT[A,G]AGATTGTGTTAAGAAGGCCAATCTA | 1,402,326 | 89 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 3889. | AATCTATAGTTCTCTTCTTACTCT[G,A]TGGTTTATATGCAGTCTTGTGGTTG | 1,402,370 | 89 |
| 3890. | TTTTTTtAATGCTTATTCTGTTGG[A,G]GTAGATATTGTTATTTTGTATGTG | 1,402,450 | 89 |
| 3891. | TTtAATGCTTATTCTGTTGGAGTA[G,T]ATATTGTTATTTTGTATGTGTGGC | 1,402,454 | 89 |
| 3892. | TATAGGTAAATGAGGAATTGTTGT[C,T]ACGACTATTTTCTAATTAATTTTGT | 1,402,557 | 89 |
| 3893. | AGGTAAATGAGGAATTGTTGTCAC[G,A]ACTATTTTCTAATTAATTTTGTATT | 1,402,560 | 89 |
| 3894. | TTTTGTATTTACCTTTTTGCCCTC[G,A]ACTTATTATTGTTTGTTCTTCTTGT | 1,402,601 | 89 |
| 3895. | TCTTTTTATTTCATCAATTGTAAG[G,C]ATGCATCTTGTTTATGGATAAATTA | 1,402,725 | 89 |
| 3896. | AGTGGTATTTTAATTTTTTTTtGC[G,A]CAGTTGAGAAATTTGTGTTATGTGA | 1,402,948 | 89 |
| 3897. | ATTTGTGTTATGTGACCATGCTAC[G,A]TTTGTGATATCATTATATGTTGTGA | 1,402,983 | 89 |
| 3898. | TTGTGTTATGTGACCATGCTACGT[T,C]TGTGATATCATTATATGTTGTGAAT | 1,402,985 | 89 |
| 3899. | GTGATCTATCGCATTGTACCTCCA[T,C]CCGAGCGATATGAACAAGAACTGCT | 1,403,227 | 89 |
| 3900. | TAGTCTCTTCCTTGTCAAAGACAT[A,G]TTGGGGTTGCATATGGATTTCTGAA | 1,403,284 | 89 |
| 3901. | ATTTGAATATGAATGTAAATATCC[G,A]CTCTTGAATATCTACCAGGAATCAT | 1,403,434 | 89 |
| 3902. | CATATTTCCCTCATCTTGGACCAG[G,A]TCCCCATTTGTTTACAAGGCAGGTT | 1,403,591 | 89 |
| 3903. | TCTTTATCTCTTATTTCTTTACCC[G,T]TTTTCCTTTATTTCTTTtCTTTCAT | 1,403,701 | 89 |
| 3904. | GTCGATCCTGTGCGGCTTCTTGGT[G,A]ATGATCATGGTGATGATTTGGATAG | 1,442,156 | 89 |
| 3905. | TATACTGACACAAGGAGAGCGGAC[G,A]AGGGAGGGGACAGGGAGAGTGAGG | 1,442,316 | 89 |
| 3906. | TCAGATGGGAGGAAAGGTATTCAT[A,G]AGTGATTTCTATCAGCTAGATTTTG | 1,442,497 | 89 |
| 3907. | GCAGAACTTGTTGTGGACTTTAAT[C,T]TCGGTGATGTTTATTTCCTCCTCAT | 1,442,807 | 89 |
| 3908. | AAGTTAGTTCTTGCCATTTGTGGG[G,A]CCATGTGGGAAGAAAGAAACAATAG | 1,442,960 | 89 |
| 3909. | TATACTGTTATATTTTtCTTTTGC[T,C]GAACAGGTTTGGAGAACTTTGAAGG | 1,443,251 | 89 |
| 3910. | TGAVAAGAATGAGGGGACTATAAA[C,T]CATATACTGTTATATTTTtCTTTTG | 1,443,278 | 89 |
| 3911. | TTAAGGGCCATGGCCCCCTCCATC[T,C]ACCCATGTTTGCTGATGTTAACTTT | 1,443,896 | 89 |
| 3912. | AAGATTTGATAAGAACCACATGAA[G,T]TCTCTAAGGAATGATCTTTAAATTA | 1,443,975 | 89 |
| 3913. | CCATAAGAGCTTGATTTATCTTGG[G,A]GAGAATGAAGGGCAGGCTCTGAAAG | 1,444,112 | 89 |
| 3914. | TCACTCTGTGGATAATACGTTATT[A,G]TTCTTTGAAGCTGATTGTGCACGTA | 1,444,223 | 89 |
| 3915. | AGGAATTAGACAGGGAGACCCTCT[A,T]TCTCCATTACACTTTATTCTCTCCT | 1,444,367 | 89 |
| 3916. | ATAAGATGGCTGTTTTAGTCAATG[T,C]GCAGCCCAGAAACTAGATGAACTGT | 1,444,422 | 89 |
| 3917. | AGGGGATTTCCTTCACAGTGGATT[A,C]TGGATCAACTCTAGAATTACCACAA | 1,444,472 | 89 |
| 3918. | ATTGCTTACCTTGCATTAGTCACC[A,C]AAAAaGAAGCTATCAGTGCATCCAA | 1,444,789 | 89 |
| 3919. | AGATTCTTGCATCTCTCCAACAG[C,A]TTCTTTGTAGGAAACTTTGATGCGA | 1,444,849 | 89 |
| 3920. | TGCTCTAGGAGGGACAAGTCACC[A,G]GGGCCGGTTGAATTTCCTGTGCTAT | 1,444,930 | 89 |
| 3921. | GAATTTAAAACTGTGATCTTTGCT[C,T]TAGGAGGGACAAGTCACCAGGGCC | 1,444,950 | 89 |
| 3922. | CAGTGTGAAAAGAAAATCATTTTT[G,T]GAATAATGGAAACTATTGACATACT | 1,445,326 | 89 |
| 3923. | AACTGCATCTTTTTAGAAGAACTC[A,G]ACATATTTAGATTTGAGAAGTGGTG | 1,445,539 | 89 |
| 3924. | TCTGCTTTTATTAGGAGGCATAAT[C,A]TTTTGGAAACTTGTTTAAAAGAAAG | 1,445,709 | 89 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 3925. | GAAGCAACACAGAATAGTACAGAC[T,C]GTCTAGAGACATTTAATTTGTGAAC | 1,446,145 | 89 |
| 3926. | TCAGCATCATTTAAATTCTTATTC[G,A]GTTGTTTGAATACATGCTAGTACAG | 1,446,987 | 89 |
| 3927. | GCATCTCCTTATTCAGCTTGACGA[G,A]TGCATGCTCCTGGCTTTCTTGAAGT | 1,447,825 | 89 |
| 3928. | TCAGTTTGTGCGGTTGATGTATGA[A,G]GAGAATTGTGAAGATATATGGGCAG | 1,447,921 | 89 |
| 3929. | AAAATATTTTGTGGATCAGTTTGT[G,A]CGGTTGATGTATGAAGAGAATTGTG | 1,447,936 | 89 |
| 3930. | CAGAATCTTGATGTTCTGCAGACT[G,C]TGGAAAATTTTCTTGAATATGTACC | 1,448,052 | 89 |
| 3931. | GCCACAAAGCCTCATTACTTCCAG[A,G]ATCTTGATGTTCTGCAGACTGTGGA | 1,448,073 | 89 |
| 3932. | TTATTTTtCTTAAATATATAATTT[A,G]ATCAATAAAAATATTTAAATTGATG | 1,448,753 | 89 |
| 3933. | TAATATTGACATATTGGCCAATAT[C,G]TTCCAACAATGATTGTTATTTTtCT | 1,448,793 | 89 |
| 3934. | ATAGTTGTTTCATATTATTTTTCG[G,T]ACGTATCTGTACCAAGGCTTTATCT | 1,448,961 | 89 |
| 3935. | TAGTAAAGCCCCACACCCACATGGC[C,T]ACATCCTCTTCTATAGTTGTTTCAT | 1,448,998 | 89 |
| 3936. | AAAATTTCTTTTCAGCTCATTCTC[A,G]AGGACATAAAGTAATAGGCATTGTA | 1,449,275 | 89 |
| 3937. | AGTTCTAGAGAGATCATTTCTGTT[A,G]GACAAAAATATTTTAGAGAGGTACC | 1,449,447 | 89 |
| 3938. | TTTACACTACAAGATGTCTTTAGT[A,G]CTTGAAGAATAAGTCCAGCTATGGC | 1,449,558 | 89 |
| 3939. | CAGTATCTGTTGGTTTTTGTCTTC[A,G]TATATTCATTAATGCTTTTACACTA | 1,449,599 | 89 |
| 3940. | AGAAATATGTTTCTTTTCTTCCTA[A,C]TGGTACTGTAAATACCCAGTATCTG | 1,449,640 | 89 |
| 3941. | CCAAGAAATATGTTTCTTTTCTTC[C,T]TAATGGTACTGTAAATACCCAGTAT | 1,449,643 | 89 |
| 3942. | AGACCAGAAAAAGCTGGGCACGTT[A,G]TTGCAAAGAAATGCTACATGCTTGA | 1,449,893 | 89 |
| 3943. | AGTTGTTTTTAGAGAAACCAGCAT[C,A]TGATGACAGTGGGGATGGAACTGCT | 1,450,165 | 89 |
| 3944. | GGAGATGGTGCAGTTGTTTTTAGA[G,C]AAACCAGCATCTGATGACAGTGGGG | 1,450,176 | 89 |
| 3945. | CCGAAAAATTTGTTACCCTTCTTT[C,T]CTTCTTTCTTTTTAGGAAATCTTGA | 1,450,847 | 89 |
| 3946. | CGGCACTCTTAGTTCTCTACTCTC[C,A]CGAAAAATTTGTTACCCTTCTTTCC | 1,450,871 | 89 |
| 3947. | GACCGAAGGCCACCGGCGATTTTT[G,C]CTCTCCTGCGCTGAAGGTCGTTAGG | 1,450,923 | 89 |
| 3948. | CGAGCCGTTTACTTCCTGAGCCGG[G,A]TTCGAACATGGTCGGGTCTCGCACC | 1,451,020 | 89 |
| 3949. | AAGAGCTGTGCAGAATCTGTCATG[G,T]TAGCCACAAATATCAAATTTCTTGT | 1,456,272 | 89 |
| 3950. | GTGATACTCACCTTCAAACGTATT[A,G]GTATTACTTAATTTATGCATTCCTC | 1,456,456 | 89 |
| 3951. | TTGGCAACAAAATACCTTGATAGA[A,T]ATGATCAACAATTACCATGAAGGAT | 1,456,667 | 89 |
| 3952. | ATCTGAAGTTCATACACGCACACA[G,T]ATCTTTGGCAACAAAATACCTTGAT | 1,456,696 | 89 |
| 3953. | CGAGTCTAATGGGTTGCTCATGGA[A,G]AAGAAACATTATCTTTCACTCCTAA | 1,456,900 | 89 |
| 3954. | CTGGAACGGTCCTTAAACTCTTGG[T,C]CACCTCTAAAATTTATTGGTTGCAT | 1,457,039 | 89 |
| 3955. | GAAAACAAGATTGGGATGCCATGT[A,C]AATTAGCAGGATAGAGTTTACAAAT | 1,458,382 | 89 |
| 3956. | ATTTTTGTACAAAAGAATCTGTAT[G,A]CTGAAAACAAGATTGGGATGCCATG | 1,458,409 | 89 |
| 3957. | TCAGCAGATGAATTACAGAGCGCA[G,A]AATGCATGTGCATATTGTGCAGCTT | 1,458,563 | 89 |
| 3958. | TGCTTCTCAACTGTATTGTGCACC[T,C]AAACACCTTTGGAACAGGGAAATGA | 1,458,971 | 89 |
| 3959. | AATTGATACTGAACCAAGCTAAGT[A,G]GTCCACATTTCTTATTGATATTCTC | 1,459,026 | 89 |
| 3960. | ATCTAACTTGTCACGTTTTGGACC[A,G]GTAGAGTGGACAAAGCTAACAAAGC | 1,459,465 | 89 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 3961. | GGCTTATCTCACCTTTGGATTTAG[G,C]TTTGAGATCCAACTACCATCCTTGA | 1,460,102 | 89 |
| 3962. | CAGTATTTGTTAAGGAACTGTATA[A,G]CTAATGTTCAGTAGATGCTAGATC | 1,460,614 | 89 |
| 3963. | CGTAGATTTTCCCAGTATTTGTTA[A,G]GGAACTGTATAACTAAATGTTCAGT | 1,460,626 | 89 |
| 3964. | TTTGATGATGATTTGCATGACATC[G,A]TAGATTTTCCCAGTATTTGTTAAGG | 1,460,649 | 89 |
| 3965. | TAGATACATATGCAGGCTCAAACA[G,A]GCACACATGCTTGGTCGACAGCCAT | 1,460,703 | 89 |
| 3966. | TTCAAGATAAACATACTTTGAAAT[A,T]ATTGTTGTAGGCAAAGCGACTTCCT | 1,461,260 | 89 |
| 3967. | ATTAGTTGTTCGGTGGAAAAAGCT[C,A]TAGAATTTCTCAGATATTATTCTGC | 1,461,333 | 89 |
| 3968. | CAGGTTACAATAAAATAGAACGAG[T,C]TGTTTATGAATATTTGTGGATGAAT | 1,461,457 | 89 |
| 3969. | GGTTCCCCTTTCGTCTTGTCTTCT[A,G]ATATTTGATTATATATCTAAAACTT | 1,461,707 | 89 |
| 3970. | TGTCTCTGGTTCCCCTTTCGTCTT[G,T]TCTTCTAATATTTGATTATATATCT | 1,461,714 | 89 |
| 3971. | ATACATACATGCATACAAGTGTAT[A,G]TCTGTGCAGGTCTGTCTCTGGTTCC | 1,461,751 | 89 |
| 3972. | TAGAAATAGATACATGCATTATCA[G,T]GGCTATTCTATTATTTTTATTTGTT | 1,461,899 | 89 |
| 3973. | TGACTTGTAGAAATAGATACATGC[A,G]TTATCAGGGCTATTCTATTATTTTT | 1,461,906 | 89 |
| 3974. | GGACACTTCATTTTAAGGTTTCTG[G,A]AAGTGTTGGCAGTTGGCACTTTTAG | 1,462,379 | 89 |
| 3975. | TTAAGTCTAGAAATGTTCTGGTGT[G,A]CCATGTGAAGCAGCAGATATTCTTC | 1,462,457 | 89 |
| 3976. | TTTCTGCAGTTCTGTTCTGTGCTT[A,T]AGTCTAGAAATGTTCTGGTGTGCCA | 1,462,479 | 89 |
| 3977. | TTTGCAAAATATGCATGATTTCTT[C,T]ATATGCCCCTTTCCACTTTGTTGGT | 1,462,529 | 89 |
| 3978. | TTAATCTCATCTGCGAAAAACATC[A,G]TGCAGATTTTGATTTTGGCCGATGA | 1,462,808 | 89 |
| 3979. | CCGCCGGCACTTGGAGAGTCTGCC[T,A]CTAGAATCATTTGATTCTGTAAGTT | 1,462,948 | 89 |
| 3980. | ATGTTTAAAAATAAAGCTAAATTA[C,T]TTTGACTTTCTATTCAAGTTTCTTT | 1,463,300 | 89 |
| 3981. | TCAGCGTATCTTCCAAAAGTTCTC[T,C]TTGAGATCATTGTGTTTAATTTGTT | 1,463,824 | 89 |
| 3982. | CTTTTATTGCCATTGTATATCTTT[C,T]TTCTGTTCCTTTTTTCCCATTTGAT | 1,463,899 | 89 |
| 3983. | AAAACAAAATTCACCCATAATATA[T,A]TATATTCTTTGCATAAATGATCATG | 1,464,050 | 89 |
| 3984. | TAAGATCTATTATCAAGTTTGACC[A,C]AGAAAGAAAAATAAACAGAGGGCAA | 1,464,680 | 89 |
| 3985. | GTTATATGTTCATCTTTTATCTAT[A,G]CATTCTTATGGTCTTATATTGCATA | 1,466,368 | 89 |
| 3986. | TTTAAATGCACCACTGTAATGGGC[T,C]ATTGAAGTTGCAAATGGTGACATGG | 1,466,979 | 89 |
| 3987. | CACAAGTATACATATTATGGCAGG[T,G]TGGTTTATTACTAACTGTTAACAGA | 1,467,083 | 89 |
| 3988. | TAATCTACAATGTGCTTACCTCAC[A,G]GATCACAAGTATACATATTATGGCA | 1,467,111 | 89 |
| 3989. | GGTTTAATATTCAAGATTTCCTTC[C,T]CTGGGACCTTAATTGTTTATTAACT | 1,467,418 | 89 |
| 3990. | TCATCAGGCTATTGCATATGCTCC[C,T]ATTCATCCATTTGATTTCCAATGTT | 1,467,483 | 89 |
| 3991. | TGAGTTTTACATCAAAAGATGGCC[C,T]GAGTTGGATGGAATGCAATTTGAAG | 1,467,868 | 89 |
| 3992. | TGTGAGTTTTACATCAAAAGATGG[C,T]CCGAGTTGGATGGAATGCAATTTGA | 1,467,870 | 89 |
| 3993. | TCCCCTCTTCTATTTTTATTTTGC[A,T]ATATTAATGTTTTTTTTtGAACTTC | 1,468,784 | 89 |
| 3994. | TTACGTTGCTGGTAAAAAATTGAC[T,G]GTAAGAATAAATTTGAAGCAGAACA | 1,468,935 | 89 |
| 3995. | GTTGTGGTTGGATTTCCTTGCATT[T,A]GCTGGGTGGTCTTCCTGCTTAGCTA | 1,469,073 | 89 |
| 3996. | TTTTTCCTGTCTTTTTTTGACAAG[C,A]AACTTCGTTTGTGTTTTTCTTTGT | 1,469,121 | 89 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 3997. | GGAATGCGGACCAGGTACTGTTT[T,G]GGGCCTTTTGGCAATACCTTTGAAT | 1,469,465 | 89 |
| 3998. | GGTCCTAGCTGAAGATGGAAATGC[G,A]GACCAGGTACTGTTTTGGGCCTTTT | 1,469,481 | 89 |
| 3999. | CAGGAACGATAGTTTAAGATTTTC[G,A]CATCTTTCTTCTTAAAAGATATGAT | 1,470,094 | 89 |
| 4000. | ACAAGTATCTATATGATCGTGTTT[C,T]TATATGTTTATTATGGAATCTTTTG | 1,470,359 | 89 |
| 4001. | GGATTTATTTTCATATTTCTGCAC[A,G]AGAATAGTGAGGTGGCAATAGAGGA | 1,470,972 | 89 |
| 4002. | GTGCCTCGGGAAACCACGACCACA[A,G]CTAATGTGCCTTGCCCAAGCCATTT | 1,471,331 | 89 |
| 4003. | ACCATGACCCTAACTGATGTGCCT[C,T]GGGAAACCACGACCACAATAATGT | 1,471,349 | 89 |
| 4004. | AAGTAACTAACCAATCAAACATCA[T,C]TCCCTCTTCTTTCTCTCACAAATCT | 1,471,406 | 89 |
| 4005. | GAGAAGCAGTAGTTCAGGGTTCCC[G,A]TGGATGAGAAAAATCATTGATGTGA | 1,471,626 | 89 |
| 4006. | TTCACTAGAAATTGGGCGCGCGTG[T,G]CGCGCGCACACAGAGAGAGAGAGA | 1,471,672 | 89 |
| 4007. | AATCTTACTAGTTCTTAAACAATA[T,C]ACCAGCATTCTGAAACAAGAAAGTT | 1,471,720 | 89 |
| 4008. | ATTGTTATCCAGTATGAAAAAAAa[T,A]ATATAGATGCGAAAATGTATTTGGT | 1,472,609 | 89 |
| 4009. | GAAATCTTGATGTTTTACTTGCAT[C,A]AATATATTGTTGTGTTTTGTGAAC | 1,473,911 | 89 |
| 4010. | GCCATAACAACTGAAATAGATATG[T,G]CATGATGGATCCTCATGGCTTTGAT | 1,473,977 | 89 |
| 4011. | TGCTGGATTGATTAATCTCCTAAC[C,T]ATGCTGAGAGCATATGATTTTTCAT | 1,474,237 | 89 |
| 4012. | CCTCCCCAGCCCTCGGTCGGCTCT[A,C]CCATTTCGATTTCCATTTCCATCTC | 1,485,539 | 89 |
| 4013. | TATCATCAGAATGATGAAAAACTT[T,C]GAATTAGTGCATGTGGAAAGGCACG | 1,486,274 | 89 |
| 4014. | CATATATGGTACTTCCTTTGCCCA[G,A]TAATGCGGGTGACTTATGAAAGCCT | 1,486,564 | 89 |
| 4015. | TAAATATTATCTAAAAAATACRRA[C,T]CTAGGAAAATATAGATTTTCAGATA | 1,486,640 | 89 |
| 4016. | TAATGCAAAAGAACATAGGTAACA[G,T]ATTTTGAAGCCACTTTTCTATACAT | 1,486,719 | 89 |
| 4017. | TTTTTtAAAACTAAAAAaCATAAA[G,A]GATATTATGGAAAAATATGGATAAAT | 1,486,794 | 89 |
| 4018. | TGTAGAGTGTGAATCATATTCACA[C,G]GAGTTTTAATGTTCTTTTGGCTAAA | 1,487,135 | 89 |
| 4019. | TGCACCAACACTGTAATAGAATGA[T,C]ACTGATACGAGATTTGGTACCGAGA | 1,487,693 | 89 |
| 4020. | TCCATCTCCTTTTGCTGAGTTCTT[A,G]CATCTAAATTTTCCTTTCTTGTTTG | 1,488,084 | 89 |
| 4021. | TTGCAAGATGATGTTGAAGTGTCA[T,A]GGTGGGGAAAACTTTAAAAGATTA | 1,488,502 | 89 |
| 4022. | TACATCATTTTCTAGATCTTCCTC[A,G]AGTCTGTATGGTCTCTCATTAAGGA | 1,489,014 | 89 |
| 4023. | TCCAAATCTTTCCATTCCCACTTC[A,G]GCCGCTCTCGGAACAGTGCTGCGAA | 1,489,607 | 89 |
| 4024. | GCAACCTGATATAGGGCTCCAAAT[C,T]TTTCCATTCCCACTTCAGCCGCTCT | 1,489,624 | 89 |
| 4025. | TACTTGATAAGCAAACCTTCAGAG[G,T]AGAGGCCCGGAACATGCAAGTCCCT | 1,489,774 | 89 |
| 4026. | ATACTTGATAAGCAAACCTTCAGA[G,T]GAGAGGCCCGGAACATGCAAGTCCC | 1,489,775 | 89 |
| 4027. | CAGGTTTTTTTtAAAaAAAAATG[G,T]ACTCGAAAACAGTTACAACAGCTGA | 1,489,949 | 89 |
| 4028. | AGAGCAACGGCTAACCCGTGCTTC[A,C]CACTAGCAGTATAGCCGTTACAAGA | 1,491,268 | 89 |
| 4029. | TTTGGAAAATATTGGTCTTTGGTA[A,G]GCACTTGACACTACAATCCTACATGC | 1,495,583 | 89 |
| 4030. | TGTTGTTACTTACCCTTTTATTTG[G,C]CTTTCGTTTGTTCGTGACCATCCAA | 1,495,745 | 89 |
| 4031. | GCCACCATTGTTGGCACATCTATA[T,G]GTGTTATATATTTCATAAGGCTTTT | 1,496,725 | 89 |
| 4032. | GCGAAGAAAGGTGGAGGCACTCAT[C,T]AAGAGGGAAAGAGCTCTGGCCTATG | 1,497,322 | 89 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 4033. | TTACACCTTTCTATTCAACAAAAA[G,A]AAGAAGAAGAAGAAGAAGAAGAAAG | 1,497,613 | 89 |
| 4034. | ACTTTTTTATTTCTTGACAGCTTA[T,C]AGGGATGGTACCTATGTAACGAAAT | 1,498,164 | 89 |
| 4035. | TTGGGAGTTGTATGGATAGATCCA[A,G]TATTCTTGTCCAATATAACTCTCAA | 1,498,248 | 89 |
| 4036. | GATGTGCAAGAGGCCATTTTGGGAG[T,C]TGTATGGATAGATCCAATATTCTTG | 1,498,265 | 89 |
| 4037. | TCTGACATATTCTATACATTCTTC[A,G]AAATATAATTACATGCATGCTCACA | 1,498,557 | 89 |
| 4038. | CCTCTTTCTTTTAACATAGACTCA[T,G]ACTTGTGGGCCTTTTCTAGGGTTTA | 1,498,620 | 89 |
| 4039. | ACTATCCAATATAGTTAATTCTGA[C,G]CTTTTAACCCTGTTTTAGACTTTCA | 1,499,153 | 89 |
| 4040. | TCTTACATTGGAGCTTTTTTAAGC[A,G]GTGACTGAAAGTCTCATTTGCAACA | 1,499,223 | 89 |
| 4041. | GACATTCCTCAGGAGGCCTACATC[C,G]ATGGAAGGTTCAACTGTAACTTACT | 1,499,698 | 89 |
| 4042. | TCAAAGCTTATCAATGGTAATGTA[C,T]ATATAAATTTGCAAAGCAAAAAGTG | 1,499,982 | 89 |
| 4043. | CAAGTGGATGGATTAACTTTGGTT[A,C]GGAATGAAAAGAACTCTCTGAGGGT | 1,501,043 | 89 |
| 4044. | TTGGAGAGATGTTCAGAACAAGT[G,C]GATGGATTAACTTTGGTTaGGAATG | 1,501,062 | 89 |
| 4045. | TGTCTCCATCTCTTCCTCCAGTGC[A,C]aTAGGTTTAGCTTTGGAAGTAATTC | 1,502,094 | 89 |
| 4046. | CCTGGTTCCTTGAATGAGAAAAAa[G,A]AAAAAAGCATATAGGATATAATTTT | 1,502,205 | 89 |
| 4047. | TTCTATAGCATGTGAGTCCACTAC[A,G]TACTAAAATAACCACACCATGTCTA | 1,502,737 | 89 |
| 4048. | TACCCATTAAAGGGCAGACACTTT[G,A]CCCTTTCTATAGCATGTGAGTCCAC | 1,502,766 | 89 |
| 4049. | TCCCCCCCTAAGCTAAGGGGTCAC[T,C]AACAGGATGAAAGAGTAGTGGATCT | 1,502,885 | 89 |
| 4050. | AGATAATAGTTTATGCTTGAGGCT[A,T]GACAATGGAGATGATGGCCTACAAG | 1,503,044 | 89 |
| 4051. | TGAGGCACCTcGCATTTAGTGCCA[C,T]ATTTAGATTTTCAACCCCAAATCTC | 1,503,371 | 89 |
| 4052. | CCAGTCTCAAATTTGAGGCACCT[C,T]GCATTTAGTGCCAcATTTAGATTTT | 1,503,385 | 89 |
| 4053. | TTTGAAATGATTGTTACTACAACA[G,C]TTACACTTTTAGGAAGTAAACTTG | 1,503,455 | 89 |
| 4054. | TTATTTGCAAGTAGTGTTGTAAGT[T,A]tGTGAAAATTTAAGAAGATTTTTCC | 1,503,553 | 89 |
| 4055. | TAGcTTTATTTGCAAGTAGTGTTG[T,C]AAGTTTGTGAAAATTTAAGAAGATT | 1,503,558 | 89 |
| 4056. | AAGAATAGCTCCATTGTATGATAG[C,T]TTTATTTGCAAGTAGTGTTGTAAGT | 1,503,579 | 89 |
| 4057. | GAATGGTATTCCAGTGTATTTTTC[A,C]AAAAAAaGATACAACTAATGGTAAa | 1,503,650 | 89 |
| 4058. | GGTTGGCACCCttCTCTTTATAAA[G,T]CATTACGAAAAGCTTCTGGACTTGA | 1,503,707 | 89 |
| 4059. | ATGTAGTATTACTTTATAATAATG[C,T]AATATTATTTTATAATAGTATAGTA | 1,508,198 | 89 |
| 4060. | ATATTATCTTATAATAGCATAATA[C,T]TGTTTTACAACTACAAAGATAATTA | 1,508,309 | 89 |
| 4061. | GTTTTACAACTACAAAGATAATTA[A,G]ATCATTTCATCCCATTTGAGTAGTT | 1,508,335 | 89 |
| 4062. | TTAAAGCAATCTCAGGAACTTTTC[T,A]GTGATTTTTCCAAGTTACCGTAGCA | 1,508,547 | 89 |
| 4063. | AAAaCATGGATCTAAAAGTGTACA[A,G]ATATAAAAATTAATTTTGAAAACAC | 1,508,691 | 89 |
| 4064. | AAGAATAAGCACACTTTATATGCA[G,C]GTAATTAGGTTTACTTTTGCACACT | 1,509,495 | 89 |
| 4065. | TAGTTTTATTCAATGAACTTTGTA[C,T]ATAATCATATAGAGGAACATTAGAA | 1,509,548 | 89 |
| 4066. | ACAATAAAGAACAGAAATTCTTGA[T,C]GATACCGAGGCTTGGCCCATCATAT | 1,509,929 | 89 |
| 4067. | ATCCATGATTTTTTGCAAACATAG[T,G]TTtGCAGAACTGCATTTGTAGCATT | 1,509,997 | 89 |
| 4068. | TTGATCCTCTTTCAAAACAAGCAA[T,G]GAAGATAAAAAAACTAGTGCAGAAT | 1,511,084 | 89 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 4069. | ATACATAGGAAGCAAAGTGGACAA[A,G]GGAGATGAAAATGAAATGCAAACCT | 1,511,132 | 89 |
| 4070. | TCATTGCATGCTGACACATTACAT[G,T]gAGATTTGTATCCTTCCGTGCAGTG | 1,512,640 | 89 |
| 4071. | AGGTTGACTTGGATATAGTTAACC[T,C]GATCAGCATTACTAGGCAGTAGGCA | 1,513,223 | 89 |
| 4072. | GGTAAACTTCACAAGATAGATCTA[A,G]AACAGAGATGTACATACTCGCAGAA | 1,523,346 | 89 |
| 4073. | AATTATTTAGCTACTAATATTCAG[G,C]TGAAAAACTTCCTTACTACATAATG | 1,523,712 | 89 |
| 4074. | TCTAGCATGCCATGCAAATGCTTC[G,A]TGATGCACTGACATAATGTGATCAA | 1,524,730 | 89 |
| 4075. | ATATGAAAAATAAATTTAAGTGGT[T,A]GAAACACATGACAAAGTACTTAAAC | 1,525,372 | 89 |
| 4076. | GTAAAAATCAAGGTTTGCCATCTC[G,A]ATACCGGACCCcGTACCGGTAAAAT | 1,525,440 | 89 |
| 4077. | GTTTGCCATCTCGATACCGGACCC[C,T]GTACCGGTAAAATTCTGCTTAATGT | 1,525,452 | 89 |
| 4078. | CGGTACGTGGTTCAGTACGGTACA[A,G]TAATGTCAGTACGCTCCGAGATAGC | 1,525,502 | 89 |
| 4079. | GCGATACAGTATTCCATGGTAAAA[A,G]CTAaAAAACAAAACATTACATCACT | 1,525,605 | 89 |
| 4080. | GAGAAGAAACTGAGATAAAAATAT[C,T]AAAAAAAaGGAAAACTCCCCAAGCA | 1,525,977 | 89 |
| 4081. | TAGTCACCTAAACCGCTTTTGTTC[C,A]CcACAAGTAATTATTGCATAAGGAT | 1,526,792 | 89 |
| 4082. | ATGGATAAAAGGAGTCATGATTTG[C,T]GGGCTCCAGATATCAAAATCTCTTT | 1,526,987 | 89 |
| 4083. | TGAAACAAGACATCTATATAAGCC[T,C]TtGACTGGTAAGCAAGCAGCAACAA | 1,527,643 | 89 |
| 4084. | CCAATAAGTCAGGAAGCTTAAACT[T,A]tAGCCACAGGCAAGCAATGCATATG | 1,527,745 | 89 |
| 4085. | CATAGCCATCTTCCTTGAATTCAG[C,T]GCACTAACTAAATGAATATCATCAA | 1,529,092 | 89 |
| 4086. | ACTCAGAAAATGCTGGTCAAATAC[G,A]CTGCAGCTTATTATCTTGGATTGGA | 1,529,163 | 89 |
| 4087. | GTGTCAGTCCTAATCAAAATTTTG[G,T]TTATGCATTGCCCAGATAGATCCCT | 1,529,218 | 89 |
| 4088. | ATCTAATAGAGAGAAAAGGGATGA[C,A]ACTAGTTAAGCGGTAGACTAGTGAT | 1,529,585 | 89 |
| 4089. | AGAGGACAGCAAGAGGAGGCCTTG[T,C]tATATATTTCAGGAGAGAAAAGGAA | 1,529,847 | 89 |
| 4090. | AGGAGAGAAAAGGAAAAGGCATCA[C,A]CTTTACAAATCAAGTCACCTTAGAT | 1,529,882 | 89 |
| 4091. | CACTTCTTAGGCTCCATTTTTGGG[G,A]gAGCCAGAAAGTACTTTCTAGCCCT | 1,529,954 | 89 |
| 4092. | GCAATAATATATTATATTATATTA[T,C]ATTATAATAATATTATGCTTTGTAT | 1,530,355 | 89 |
| 4093. | GTCGAAACTTCCCTTTTTATCTTA[T,A]AAGAAAGCCTCAGAATTTTCAACCA | 1,531,566 | 89 |
| 4094. | TGGAAACTAAATTATCTACCCATC[G,C]AAGAATTGCTGTTTTCTCAAACAAA | 1,531,661 | 89 |
| 4095. | GAGAGAAAGCCGACGCCCGCGGGG[C,G]TCTAGGGTTTCTTTTGGGCGGCTTT | 1,531,989 | 89 |
| 4096. | GTGCCATCTTTTGCCGGACTGGGC[T,A]TGTTCTCGCTCGTCGTTGCGTTCGA | 1,532,259 | 89 |
| 4097. | ATGGACCCAACGACGTTACCAAGG[A,G]TGACTCTTTCCCATGTGGCACTAAT | 1,532,332 | 89 |
| 4098. | CACGTGGTTCACGAACGGTTTTGC[T,C]CATTCTATCACCCATGGTCCCTAAA | 1,532,669 | 89 |
| 4099. | TTAAAAaGATTTATTAGCTGTGAT[C,T]TTTAAAAAATTGTAAGTGTTtTTTT | 1,532,952 | 89 |
| 4100. | TACCTTCTCCTTTTGTCAAGATGG[A,G]AGGGACTCAAATCGAAAACACTAGT | 1,533,172 | 89 |
| 4101. | TATTTTACTAACTTTACCAACTTT[G,A]TTATTTAGCTTCCTCAAATTGATCA | 1,533,225 | 89 |
| 4102. | GTGGGGGGCGATAGAGACTAAACC[C,A]ACAGAGAAGTGTTCAATCATAGAAA | 1,542,453 | 89 |
| 4103. | ACTTAAAAGGCTCCTCAGGGCATG[G,A]CAAGAATATTATTCTGCCTGCCAAC | 1,542,521 | 89 |
| 4104. | ATCATGTTATCACATCTTTAGGGT[C,T]TTATGGCTTCATGAGGATGCTGCTA | 1,542,644 | 89 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 4105. | AGCCTTTACACGGATCGCAGACCC[G,C]AAGTCAGTGGCCgACATATTGTTCT | 1,542,954 | 89 |
| 4106. | ATCGCAGACCCgAAGTCAGTGGCC[G,A]ACATATTGTTCTTTAAGCTTCTTTT | 1,542,967 | 89 |
| 4107. | TATCCCATTCCGCCTGCATATTCT[C,T]TTCAGCGTAGTTTGACAAACTGACA | 1,543,599 | 89 |
| 4108. | TAGAATTACTTCACTAATATCCAT[A,T]TCATCTTTAGGTCCACAATATTTCT | 1,543,809 | 89 |
| 4109. | ACCTCATGATCCTTGTCGTGGTCT[T,A]GGTAGGATATTACACCATAAGCAAA | 1,544,216 | 89 |
| 4110. | TATATATCACAAGCTATAGAACCT[A,G]TATGACAACCATGATGAATTTTCAT | 1,545,240 | 89 |
| 4111. | GCATCCTTTTTCAGTTATCTTTAT[G,A]TTACTTGGTTAGTTTTGGAGGATGT | 1,545,406 | 89 |
| 4112. | TTTATGTTACTTTGGTTAGTTTAT[A,G]GGATGTGTTTTTTACTTCCTACATT | 1,545,425 | 89 |
| 4113. | GATGCAAGGGCTACAGTTTATAGC[C,T]CTAGGTAGCTAGAACCATATTGTCA | 1,545,534 | 89 |
| 4114. | GTGTGATTAAGATCAGCACCTGAC[T,C]TGGATGAGCATCTCCTTGTTTACCA | 1,545,908 | 89 |
| 4115. | TGTGATTAAGATCAGCACCTGACT[T,C]GGATGAGCATCTCCTTGTTTACCAG | 1,545,909 | 89 |
| 4116. | GTAACATGTGTGCATGACAAATGG[C,T]TCTCAAGACATCCAATATCTCTGTG | 1,546,580 | 89 |
| 4117. | AGAAACATTAAGTATTTATTGGCA[T,C]tAAACCTATAATTGTTATATCTATC | 1,546,889 | 89 |
| 4118. | TATAATTGTTATATCTATCACAAA[C,A]AAGAATCTTCATGTATTCATTCTAC | 1,546,920 | 89 |
| 4119. | TTCTACATGCTTGTGTAACTAGGA[A,G]CATGTAAATAAATACATTGACAGAC | 1,546,964 | 89 |
| 4120. | GACAAAGATATCCATGCATATGCA[C,T]GCAGGCAGTGGCTACATTTATGATG | 1,547,011 | 89 |
| 4121. | TATCCCTGCACCTGAGGATTCCTT[A,G]AACAAAGACAGTGCCTTGAGCAATC | 1,547,758 | 89 |
| 4122. | TGCACCTGAGGATTCCTTAAACAA[A,G]GACAGTGCCTTGAGCAATCTCTCAG | 1,547,764 | 89 |
| 4123. | CGGTGGACTGCAGAGTTCAGTGAA[C,T]GTATTGATAGCCTTCTGCGCTGAGT | 1,548,136 | 89 |
| 4124. | AAACCAGCTCGTTTTCCTCTAGCT[C,T]ACAGTGGATATTCCATTCTCTTGCT | 1,548,270 | 89 |
| 4125. | TCTAGCTCACAGTGGATATTCCAT[T,C]CTCTTGCTCGACAAATTAAACCTTG | 1,548,287 | 89 |
| 4126. | CTTGACATAATACCTCCCTCCAAC[C,A]GTAAAAACCAGACCTTTTACTGAAG | 1,548,333 | 89 |
| 4127. | CAACTAGCTCAAGGTCGAATTGGA[T,C]CCTGAACTTTCCCTATCAAATTGGA | 1,548,487 | 89 |
| 4128. | GACAACGATGAACTAGCTCGATCC[A,C]GTCCGGACCCAGCGAAAGGCCCAAC | 1,548,544 | 89 |
| 4129. | GCAGGGTTGTCTCTGCCATGCTCT[T,A]GTACTGGATGTTCCCCTATACATCC | 1,549,448 | 89 |
| 4130. | ATTGCCTTGTATTGATAGGAAAAA[T,C]TAAGAGCTGCTGCTCAATGATGAAA | 1,549,532 | 89 |
| 4131. | TATGGTAAATGCTGTCACCTCCT[A,G]AATTAATCAAGCAATACAAGTAAGG | 1,550,218 | 89 |
| 4132. | GGTGGATTGCACGCCGTCGCGTCT[T,C]CCTGTAAATACTGGGTACTTGGGTG | 1,550,609 | 89 |
| 4133. | GTGCACCAGCCTTCAAGCACAACA[A,C]CATTGCCATAACATCATGTCAATAT | 1,550,656 | 89 |
| 4134. | GTTTACTAATTTAGTTCTCTTGAT[A,T]GGCGAGATTTGTTGAATTGATTAAG | 1,550,771 | 89 |
| 4135. | TTCCTTGTTGAAATCGGCGGAACT[T,C]GCTGATCTGACACAAAATACTTGCT | 1,550,821 | 89 |
| 4136. | GGGGCTCCGGTGATTTATATAGAA[A,G]GCTGTCAAACAGCTAATTATATAGC | 1,565,285 | 89 |
| 4137. | TGAGATTGTACGATCCTAAAATTG[C,T]GGGGCCATTGGACATATCATTGTGG | 1,565,337 | 89 |
| 4138. | GAATCCGAAACGTCAAGAGACAGG[C,T]CAAAAATATCGGAGCATCCGGTGCA | 1,565,676 | 89 |
| 4139. | TCAAGAGACAGGCCAAAAATATCG[G,A]AGCATCCGGTGCACAGATACAATCT | 1,565,688 | 89 |
| 4140. | TATTTCGGAAAATCCAGATCTAAT[G,A]GATAACATATTGCATCTTATCTATC | 1,565,756 | 89 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 4141. | GAGTTGGCTGGGGTTGGGCAGACA[A,G]CGTTAAAGGTTGGCAGAGGGGAAAC | 1,568,567 | 89 |
| 4142. | CCAGAAGTTTTTTATGCAAAATTT[A,G]ATCTTCAATATGTTGTTTACATGTT | 1,568,775 | 89 |
| 4143. | TTGGTTTGTTTGCATGAAACAAGC[G,A]TAAGTATGTATGTAATGAACATAAA | 1,568,922 | 89 |
| 4144. | TACACACTAGGGACTAAAAGTTAC[A,G]AGGAACATGGTTGGGCTTGACATGA | 1,569,005 | 89 |
| 4145. | CCCATTTTTTGGTCCCTTTTTAGC[T,C]GGAGTGCTCATATCCTAAGAATTGA | 1,569,087 | 89 |
| 4146. | AGATCAATATCCATGTGACACACA[A,G]TATTGTCAGCTTCAAAGATTCTAAA | 1,570,116 | 89 |
| 4147. | ATCAAAGAAAGAAAGAAAATGAC[A,C]TTTCATCCCCTAAGCTATCCAAAAA | 1,570,197 | 89 |
| 4148. | CTGTGTGCTTGCTAAAGTTGTCGA[G,T]TTAAAAACCACTTCCCCCACCAAGC | 1,570,648 | 89 |
| 4149. | AAAAACCACTTCCCCCACCAAGCC[C,G]CAGAAAGGGGAAAAATGAAAGGAA | 1,570,675 | 89 |
| 4150. | GGCATTCAACTTGTTAAAAATAAC[A,T]TTTGGAGGGGAATTAATTAACTATT | 1,570,776 | 89 |
| 4151. | AACAATAGTGAATCTGACTGAGGA[G,A]TTGGAATCCATAGATACTAGTCTAC | 1,570,955 | 89 |
| 4152. | AATCTCACAGGCAAGGTTTAATAT[A,T]ATTATAACCTGTAATATAATTATAA | 1,571,498 | 89 |
| 4153. | GTTTCTGTGTCATACTGGATTAAA[G,C]CTTCTGCTTACAACACAAAGCTAAT | 1,571,853 | 89 |
| 4154. | TTCTGAGGCTGTGAGCAGCCAGGA[G,A]ACAAGATTTACCAATCCATTTGATT | 1,571,971 | 89 |
| 4155. | ATCATTTCAGAAGTTGCACAGGCC[A,T]TGCCATTCAGTACAAGGTCACCTTG | 1,572,139 | 89 |
| 4156. | TGAGAAATCTATGGGTGAGGAAGC[G,T]GgAATTAAAGCAGCTACAATTGAAT | 1,572,432 | 89 |
| 4157. | CAGCCTCCCATTCATAATTGAGAC[T,C]GTTATGGTGAATCTGGCCGATATAA | 1,572,754 | 89 |
| 4158. | ACTCCATCAATGATTAATTATTGG[G,A]gTAGTTGAGTATGGGGACTCATACA | 1,572,863 | 89 |
| 4159. | TTGGGgTAGTTGAGTATGGGGACT[C,T]ATACAAAAAAGATGTTATAGGAGGT | 1,572,883 | 89 |
| 4160. | AGACTGCAAGTAGTGGAAGATGTT[A,G]AuCTTAGTATTTTCCTGAATAGCCT | 1,573,185 | 89 |
| 4161. | TTGCAAGCACATCTACATCTATCT[T,A]GGGAGACATTTAACCTTTGTGGTTC | 1,573,292 | 89 |
| 4162. | CAGGTCATTTAAGTTTTCACGTAC[G,A]gTTTTTTTtCTTGAAGGAATAAGA | 1,574,513 | 89 |
| 4163. | TTTTCACGTACGgTTTTTTTtCT[T,G]GAAGGAATAAGAAGGATATCTCCAT | 1,574,526 | 89 |
| 4164. | atCGCACCGATGCTCCTCCGGTGC[C,A]GTATGGCACGGGGCTCTCCATGGGT | 1,582,566 | 89 |
| 4165. | AGTAGTTCCGTAATTCCCAATgAs[T,C]CGCACCGATGCTCCTCCGGTGCCGT | 1,582,589 | 89 |
| 4166. | AAGTGATGCCAAGCACGTCTTCCA[C,T]ACTTAGCTTCGAGCAACCTTCTACC | 1,582,657 | 89 |
| 4167. | CAGGATCTGTCACAAATTGTAATA[G,A]AATGTTGATGATCGGCAAAATCTAG | 1,584,707 | 89 |
| 4168. | GAAGAAATGAAATTCTCAGAGGGA[C,T]GGATACGAAAGAAACTTACATCTCA | 1,585,012 | 89 |
| 4169. | AAGGAGAGACGAGCGGTGTTCACC[G,A]GCAACCTTGACATCTGTATTCATGT | 1,585,706 | 89 |
| 4170. | CTCATCAGGTAGGGATACATAGGT[A,G]GCATGGGAAGAATCAGAGACCTTAA | 1,585,802 | 89 |
| 4171. | TTGCCATTCGCTGCTTGTTTCGAG[A,G]GTGCAGAGCTTGACTTACTGAGCAG | 1,586,173 | 89 |
| 4172. | CGAGGAACCTGCAAGTTTGAATAA[G,A]TGAATAAATAAAGAATAAGATGTTC | 1,587,387 | 89 |
| 4173. | TAGAGACAAACTTGACTAAGCTAG[C,A]GAGATTAAGATTGTTAGTAGCCTCT | 1,587,581 | 89 |
| 4174. | TGTTATATATGTGCTATGATGATA[G,A]TTATAAGCTAAAAATAGAAGATACA | 1,587,805 | 89 |
| 4175. | GACAGATAGTAAAAAAAAaTGACA[T,C]AATTGTTATGTCTTTGCCTTTAAAG | 1,592,169 | 89 |
| 4176. | TAAGAATTAATAGTTTTGATATGA[G,T]AGAAGAGTATGCAGAATTTATTTTT | 1,592,460 | 89 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 4177. | TGAAGCATTCGAGGGTAATTAGCA[C,A]GTACCATGGATGGGGAATAAGAATT | 1,592,502 | 89 |
| 4178. | TGTAGACTTAAAACGCCGGGCTGC[G,A]TCCACTCCTCTTAACCCACATCCTC | 1,593,096 | 89 |
| 4179. | CCCACCATCCATGGACGACTTGCC[C,A]AGTCTCCGTGGATGTAGACTTAAAA | 1,593,133 | 89 |
| 4180. | CACCGGCGACTCCGGGACCCACCA[T,C]CCATGGACGACTTGCCCAGTCTCCG | 1,593,150 | 89 |
| 4181. | ACAGATGGGCGCTTTGGTATCCAA[C,T]CGTGGAAATATTAGTCACCGGCGAC | 1,593,190 | 89 |
| 4182. | CCTTGTAAATGAACTGACTAACAC[G,A]GTACCTAATGACAAAACAATTTTGG | 1,597,621 | 89 |
| 4183. | ATAATTTACTGCGAGTGTTTGCTG[C,T]AGAATGGATTAAACCGATCTATCGT | 1,597,765 | 89 |
| 4184. | ATTGGCTCCCACCCTAGCATCAGC[A,T]GCCTACAAGATGGCACTGATTTCCT | 1,599,476 | 89 |
| 4185. | ATGGGTGCATATAAAAAATGGTA[A,C]CTGAAAATGAAAATTGAAACTAAAC | 1,601,193 | 89 |
| 4186. | GTTTGCAGGGATTGGTTATGGTCG[C,T]AGACACCCCTACTCCTCAAAATTAG | 1,601,507 | 89 |
| 4187. | GAGTTTGCAGGGATTGGTTATGGT[C,T]GCAGACACCCCTACTCCTCAAAATT | 1,601,509 | 89 |
| 4188. | CCGGCTAGCATGGATTCCGGTTCT[C,A]GTTCCGCGGTCCTTGATCTAGGTCA | 1,601,726 | 89 |
| 4189. | TAGGCAAGAACGCTACAGTGATTT[A,C]CCTGCCACACTTCAATCCCTACATA | 1,604,187 | 89 |
| 4190. | TTAGTGAAAAGAATTAGGCAAGAA[C,T]GCTACAGTGATTTACCTGCCACACT | 1,604,201 | 89 |
| 4191. | AAAAACATTTGTGGCAAATTATCC[G,A]TTAATCTTTAGTGAAAAGAATTAGG | 1,604,233 | 89 |
| 4192. | TTAATCTGACTACCGAAAGTTGAT[G,A]ATGTTTAAGAAACAACAATGTTG | 1,605,145 | 89 |
| 4193. | GTCTTTACCAATGGATGGTAACCT[G,A]CAGGACAAGAGATTCTAAGTTCTTC | 1,606,417 | 89 |
| 4194. | CAAAAGAAGCACGAAGGTTGGAG[T,G]GTCATGATTTCATTAAGCAACCAAG | 1,606,610 | 89 |
| 4195. | CGAAACCTTGGTTAGTGGACGTCT[G,A]ATAAAATAAAATCCCGTATATACTG | 1,606,669 | 89 |
| 4196. | TATGCAAGTCAATCTGCCTGTAGT[T,C]TGAAACGACTACAGAAATCCCTAGA | 1,606,719 | 89 |
| 4197. | CTTTTCCCCAGATAACATTGGACG[C,T]AAGTTACATATAACATTGAACATTT | 1,606,789 | 89 |
| 4198. | CAGAGAGGTCAAAATTAAACTCTC[C,T]AGTCCAAAATTTTTTAAGTTtCTTT | 1,606,835 | 89 |
| 4199. | CTTTATCGTGCATGTCACTTTCAG[T,A]AACCTTCCTCCCTGATGTTTGCTAG | 1,606,888 | 89 |
| 4200. | TTGTAAGGAAAAAGATGTAGGAAT[G,A]CGTGAAAACATGCAGTCAAGGTACA | 1,607,032 | 89 |
| 4201. | ACAATGGTAGGATTAATAATTGAA[A,G]ATATTGTAAGGAAAAGATGTAGGA | 1,607,060 | 89 |
| 4202. | CCAACATTATATAGATGGTTATAT[A,T]CGGCTGTACAGGTTACATGATGCAT | 1,613,951 | 87 |
| 4203. | TTATTGCTATGGATATCATGGATA[C,T]GTACAGTTGGTTTAGGCATCACAGT | 1,614,239 | 87 |
| 4204. | GAAAGGAAAGAAAGGAAGGTAGA[G,A]GAAAAGAAAGAAAAGAAGAGAGAGA | 1,614,509 | 87 |
| 4205. | CACCGGAAGAGATGAAGAAAGAGG[A,G]TAGAAGGAAAGGAAGGAGAGATGAA | 1,614,609 | 87 |
| 4206. | ACCCATCCACACCGGAAGAGATGA[A,G]GAAAGAGGATAGAAGGAAAGGAAGG | 1,614,618 | 87 |
| 4207. | ATCAAGCCCTTCAACATGGCCCGG[G,T]ACATGGCTATACACATGGGGAATG | 1,614,786 | 87 |
| 4208. | TTTTTACAAATAAAAGAACAATAT[C,T]ACATTAAATAAATCAAAAGAGAAAA | 1,615,088 | 87 |
| 4209. | ATGTGATTAAGGGTGGGAAAAATC[A,G]GATATGCATTGCAAACAGTGGATAG | 1,615,313 | 87 |
| 4210. | TGATGACAAAGGATATGTGATTAA[G,A]GGTGGGAAAAATCAGATATGCATTG | 1,615,327 | 87 |
| 4211. | GAATGAAAAAATATGAGCAGGTT[G,T]CAAAGGATGATATTTAACACAGATT | 1,615,480 | 87 |
| 4212. | AGTGAAATTTTGCCTAGGATGCCA[G,T]AAGAATGAAAAAAATATGAGCAGGT | 1,615,507 | 87 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 4213. | CTCCCACAATCTTGAAAAAGGGGG[A,G]AAAAAaCCTTGGAATAATGGAACGG | 1,615,570 | 87 |
| 4214. | AATAATTGGGTCAAGGGGGTCTCT[C,T]CCACAATCTTGAAAAAGGGGGAAAA | 1,615,592 | 87 |
| 4215. | ATAAATGTAACTCTGAGGCCCTTT[T,C]GGTGTTAGGAGGATGAAACCAAGTT | 1,615,837 | 87 |
| 4216. | TTTAGATTGCATTCAACTAGGGTC[C,T]GGGTTTCTGGGTCTCAGGGATGACC | 1,615,983 | 87 |
| 4217. | TTTATCAAATCTGTCTGAGTGATT[C,G]TTCAACTCTAGGTGGGAACAGTTTG | 1,617,499 | 87 |
| 4218. | CCACTACATGTGGAGAGGCTATTT[C,T]CATGTTTCAAGCCCGTGAGAAATTT | 1,618,241 | 87 |
| 4219. | GGCAGCCCAGCTGCACTAGGCTCC[T,C]GCCACTGCAGGGTCCGGAGAGGGTC | 1,618,308 | 87 |
| 4220. | TTTATAAGATTTCTGAAACCAGGT[T,C]AGGTTTTTCAATTGAAGCAGGGCAG | 1,618,353 | 87 |
| 4221. | ATTAAGAATTTACAAAAGCATCAC[G,A]CATACCATCCCCGAAATATATGCCA | 1,618,413 | 87 |
| 4222. | ATTAAGGTCAAATTGCAGAGAACC[T,A]AAAAACTTCAAAAATCCTTAAATAC | 1,619,009 | 87 |
| 4223. | ACTTCTACTACATAAAAGTCAGCC[T,G]GTTATGGTACACTATTGATCACTAG | 1,619,076 | 87 |
| 4224. | TCTAGCTTCTAGCCTCCAGCAAAA[A,G]GTAAGGGTTTCCAGCTTTATCGCTT | 1,619,307 | 87 |
| 4225. | TTCCTATTCAAGGTTAGTACCAAA[G,C]CAACCCACAAAAAAGGCATGGCACA | 1,619,944 | 87 |
| 4226. | TTTACGTGCTCTTCAAAGGGTAAG[C,T]GTGCTAAGTCATTAGCACACTAAAT | 1,619,996 | 87 |
| 4227. | CCCACACCCTACGCCCGAGCCCAC[C,G]CCCGCACCCCACCACCTCCTTCTCC | 1,620,106 | 87 |
| 4228. | TGCAGACCGATCACCCACACCCTA[C,T]GCCCGAGCCCACCCCCGCACCCCAC | 1,620,119 | 87 |
| 4229. | GGGAACATTCCTGTGCTATTCTGC[G,A]ACACCAAGGCTTACTCAAGATCCAT | 1,620,311 | 87 |
| 4230. | ATCATGAAGGGCTATGTCAATGCC[T,A]GGAATTCTGTCCCTGTCCTCACTGG | 1,620,493 | 87 |
| 4231. | GTGATTTCCAATTCTGATCTTTAG[A,G]AAATAACCATGTCAAATGAACAAGT | 1,620,803 | 87 |
| 4232. | TAAGTCATGATAAGAGTAGAACAA[G,A]ATAAGAAAAGGAATGAGTATAACTG | 1,620,888 | 87 |
| 4233. | TCAGCAGATGAGTGTCATTATTGG[G,A]ATAGAATCGGTCATTGCAAACAAAA | 1,621,313 | 87 |
| 4234. | TGATTCTAATATTATATGCATGCA[C,T]CATATTTAAGTCTGTCTATTATACT | 1,621,413 | 87 |
| 4235. | ATGATTGTGCCCGAAATAAAATTT[C,T]GGATGGAGCAATAGGAAGTACAGAT | 1,621,713 | 87 |
| 4236. | CAAATGAGTTTGAACTTTGAATGT[T,G]GTCAGAATCAGGAGCTTTGAGTTTT | 1,621,787 | 87 |
| 4237. | AGATACCATTATATAATGACTGTT[G,A]ATTATCCTTATATAACACCTCATTG | 1,621,906 | 87 |
| 4238. | CCAAGGCTTGCGCATCACTTGCAG[T,C]AGATGGGATTTTCAAGTTCTGTCGG | 1,622,560 | 87 |
| 4239. | GGAAAACTGATAGCAAGAAACAC[C,T]ATAGTGATTATATTGACATGATCTG | 1,622,965 | 87 |
| 4240. | CCCTAAATATAACTTTAGAATGTT[C,T]TATCATAGCTTCATTTGCTCTTCAG | 1,623,039 | 87 |
| 4241. | ATTTGTGAAATTGTAATACCTTTG[C,T]TCTTGCTATTATTTGCAAGAGCATT | 1,623,276 | 87 |
| 4242. | TTTTTAAAAAATTTGTGAAATTGT[A,T]ATACCTTTGCTCTTGCTATTATTTG | 1,623,286 | 87 |
| 4243. | TTATTCAAGCTGACGGGAATTTCA[A,G]TAGTATAGAATTATTGAACGATCAA | 1,623,562 | 87 |
| 4244. | TGTACACAAATTTTTGAATTCAAA[C,A]AAAATTTCTTTtATTTTTCCACTTT | 1,633,772 | 87 |
| 4245. | ACACTTGTATCACTGTAAGGTACA[C,G]TTCAAATGTACACAAATTTTTGAAT | 1,633,803 | 87 |
| 4246. | GAAATGAAAGTGGAGATCATGTAC[A,C]CATGCATGCATTAGTTTCATCTGTA | 1,633,884 | 87 |
| 4247. | TAAGTTCAAGTTTCGGCAATGACC[A,G]TGATTTTCCAACTATCAGAAATGAA | 1,633,926 | 87 |
| 4248. | TATGTAGTTTAGATAATAATTTTA[A,G]CTGTGCTCTCCTTTTTTAATAAGTT | 1,633,970 | 87 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 4249. | CCAATCAAATATAAAAAGTATAAA[T,A]TTTTCATCCAATGAGAGGGTCAAAA | 1,634,689 | 87 |
| 4250. | ACCTACAGCATAACCAAAAAAATG[G,A]TGCTGGTAATTGTTAGATCCTTTAC | 1,634,963 | 87 |
| 4251. | AACCAGCAATAGGATTTTGGCAGT[T,G]GATGAGATAAAAGTTCTTCCAGACA | 1,635,187 | 87 |
| 4252. | ATTTGATGAAGTCAAAAAGGATGG[T,C]GGAGATAAAAGGGGTTTATCTAGTA | 1,635,869 | 87 |
| 4253. | TAGCTCTTTTATCCTTTTGTAATT[G,T]GGTGGTCCACTTGGAGACAGGAAGA | 1,635,959 | 87 |
| 4254. | GGAAGTGCCATCCATTTGGCAATG[G,A]GGTGAGACAATGCATTGGTTTCAGA | 1,636,199 | 87 |
| 4255. | AAGATTGATCGGCTCAGCTATAAA[A,C]TAAAGATTGCATTTATAGTAACTAT | 1,636,378 | 87 |
| 4256. | GAAGTTCTAAAATGCAAGCTAGCA[A,G]GAATAAGAAAGTAATCACAAGTACA | 1,636,691 | 87 |
| 4257. | TCTATAACATTCAAAATCCTAAAA[A,G]CCAACAATAATCTCCCGTGAGGTTT | 1,636,971 | 87 |
| 4258. | CACATGCGTGCTGCAAGACACATG[T,G]TAAGCTATACAAAGCTATATAACTT | 1,637,034 | 87 |
| 4259. | TCACCCCTCTATCTCACATGCGTG[C,T]TGCAAGACACATGTTAAGCTATACA | 1,637,048 | 87 |
| 4260. | GCTAGCTGCTTTGCCTCACCATGG[C,T]TGGCAACCTGCAAGCAAATGGCTCC | 1,637,430 | 87 |
| 4261. | CAAACTGAAGTGTGTACATTCCCC[G,A]TTCCCACTTCCCTCTTCCTCTTCCC | 1,637,533 | 87 |
| 4262. | AATGCCATTTTTAGAGCATCATGT[T,C]TATTTTATATATAAAAAAAaGATAT | 1,638,363 | 87 |
| 4263. | ATTTTGTGTTATATAGGTTCCCTG[T,C]TTGCATAGTTCTGTCAAATTATAGA | 1,638,623 | 87 |
| 4264. | AGTCATAAAAAATTCAaAAAAAAT[C,A]GAAGGAGAAGAAAAGAAAACAAGAA | 1,638,695 | 87 |
| 4265. | GCTGGCTCCATAAAGTTTCCATTT[T,C]GGCAGTTTCAGTGATTTTGTAAGTT | 1,638,774 | 87 |
| 4266. | ATGTTGAAATAGTAATTGCATATG[G,A]AAATTAGTGGTAGCTTCAATTTGAA | 1,639,005 | 87 |
| 4267. | AAATAACTATAATCTGAACAATGA[C,T]GACACTGACAGGCTGAGCTGGTAAA | 1,639,673 | 87 |
| 4268. | CCTTTTTTtATTTACCATTATCA[C,T]TAGATAAGCATGCTAGAAAACAAA | 1,639,809 | 87 |
| 4269. | TCAAGCCCTGTTACCTTTATAGAT[G,A]CTCTCCCCTTAAATCTACTGTAACA | 1,639,867 | 87 |
| 4270. | GGCATCAGCCTGAACAGTTAGTCA[A,C]TTTCATTTTCTAAGGTTGCCACATG | 1,639,956 | 87 |
| 4271. | ATTCCTCAAATAGGACACGCTACA[G,A]GCATCAGCCTGAACAGTTAGTCAAT | 1,639,980 | 87 |
| 4272. | CAGTCACCTTTTCTGGTAGGATAG[A,G]AAGGCCATGAGTTAATTCCTCAAAT | 1,640,019 | 87 |
| 4273. | TCTCATAAGGAAGCCAAAAGAAAG[A,G]AAAATCTATTCAAATACGAGGTTGC | 1,643,151 | 87 |
| 4274. | GAACTTGGGCTGTGTTGCTTATGA[T,C]AAGGTGTAACTCCTACATTCCATCT | 1,643,419 | 87 |
| 4275. | CATCCAATAATTTCTCGCCAGGCC[A,G]GGGCCCCACCTGATTTATTTGGATA | 1,643,611 | 87 |
| 4276. | TTCACTTGCGCCTGGTGCATCCAA[T,C]AATTTCTCGCCAGGCCAGGGCCCCA | 1,643,628 | 87 |
| 4277. | CATACCGTGAAACTGTTTGCTGCC[T,G]TCTATGGCGGGCTTTTGTCAAGGCA | 1,643,810 | 87 |
| 4278. | GTGTGCGTCGACCATACCGTGAAA[C,A]TGTTTGCTGCCTTCTATGGCGGGCT | 1,643,822 | 87 |
| 4279. | CGATTTATTTGAAGGCATCGGCGG[T,C]GCAAAAGCCCTATAACAGATCTGGC | 1,644,152 | 87 |
| 4280. | TTGATAAGATAGTACAGAAGTTGC[T,C]ATACTGTATCAACCTTCCTTGTTAA | 1,644,960 | 87 |
| 4281. | TCATTTAACTGACCAAAAAAAAAC[A,C]CAGTGATGGCATTTTATTAAAGAAA | 1,645,014 | 87 |
| 4282. | TGTTAATTGCCATGTAATATCCTT[T,A]ATCACAGGGATCCGCATCATGTACG | 1,645,330 | 87 |
| 4283. | CTAGACAGTGAGCAAACAAAATGA[A,C]CCAAAAAAAaGGTGAATCAAAAACA | 1,645,464 | 87 |
| 4284. | AATCATTTTGAAAGTACAAAGCAA[A,G]AACATTTATCCTGAATGATTTCTCC | 1,645,845 | 87 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 4285. | ACATATTCATGGGACATTGGCTGG[T,G]GCACACCTAGCCCATCGCCCCATCT | 1,646,022 | 87 |
| 4286. | ACAATTACCTCAAAATAAGATGTT[C,G]TCGATGACTACATTAGGCATGAGAA | 1,646,721 | 87 |
| 4287. | GCATGCGGGATAAGGTTGTGCAC[G,A]TCCAGACCCCACAATGGCGAAAGCC | 1,646,807 | 87 |
| 4288. | TCAAAATACGTAAACAGCCTCTCC[G,A]CATGCGGGATAAGGTTGTGCACGT | 1,646,831 | 87 |
| 4289. | CGAAATTAGTTGCCTAAGAAATTC[G,A]ACAGGTACTTGCAAAGCTACCTATG | 1,647,719 | 87 |
| 4290. | ATCTTGTTTGCTGAACAGAAAGTG[T,C]AAACCTAGTTATGGCATATCTGAAG | 1,648,270 | 87 |
| 4291. | ATTAACGTTTAAGTTGGAACAACA[A,T]TCATATATGTCACCGATTATATGTG | 1,648,545 | 87 |
| 4292. | AAAACATTAGACCCAAGAACCAAC[T,C]GCTGGTAAGTTGGATGACCAAAAAA | 1,648,606 | 87 |
| 4293. | TACCATTACACCAGGTGTAAAAGG[T,A]AACTGGTGATAAGCAGGCAAACAAA | 1,649,651 | 87 |
| 4294. | TCAGTATGATCCAAAATATGCCAA[C,T]GATCATCCAAATATAATGTCAGCGA | 1,649,897 | 87 |
| 4295. | ATGTTAAGGTAGCAGAACAGCATT[C,T]CAAATACTAACATAAATAAGGATAA | 1,650,173 | 87 |
| 4296. | TGCATAATGTAACTGAATTGCATT[G,A]ACCTCATCAAACACAAAAAGTTGCA | 1,650,329 | 87 |
| 4297. | TATGTACTTAGTACTTTAGGCTTA[T,A]GACTTGAAGTTTTAACTTGTAGGAG | 1,650,399 | 87 |
| 4298. | TCAGACTGCCTGTAATTAGAAATC[A,G]GACTTGAAGTTTTAACTTGTAGCAG | 1,650,637 | 87 |
| 4299. | GAAAGCACTATCAGTCGAAGAACC[G,A]TCCGTCCTGGACCTCTTCACATCTC | 1,652,345 | 87 |
| 4300. | CTTTCCTACTGCCACGCACCGAGC[A,G]TGGCAAACGGGAGTTCCACCTTTGG | 1,652,558 | 87 |
| 4301. | GGATGGCGGAGGAATTGCCAGTTG[T,C]GGTACCACAGCATTAGTTGATTGCT | 1,653,038 | 87 |
| 4302. | ATTGACCTACTTTGCTTCATTATG[A,C]ATCATAATATTTCTACTGCTTTTCA | 1,654,508 | 87 |
| 4303. | AATTCACAATGAGGAATCTTGTGC[G,A]CCCCTCATTGTCGGGATAAGAATA | 1,655,827 | 87 |
| 4304. | TGATTTCTCTATTAAGATTTGACA[C,T]TGAGGCGACCGGTTTAAGCACGTCA | 1,656,187 | 87 |
| 4305. | TTCCTCTATTTGATGGGATTCCTC[G,A]TATCCATCGGAGATTAGAGCGGGAA | 1,656,593 | 87 |
| 4306. | CTCTCCTCATGACAAGCGCATAAC[T,C]TTCGCAAACGTGTTTGTAAATAGCC | 1,656,828 | 87 |
| 4307. | ATGGCATATCAAAATCCAACTCCA[G,A]ATTCTAAAATTAATATCTGCAGTAC | 1,657,314 | 87 |
| 4308. | TGCCTACGATGGGAATAGTTACAC[T,C]AGAAATTGTTCCAATTTTTGTTTGG | 1,657,628 | 87 |
| 4309. | TATTAGGCTGGATTTGGATCGAGA[A,G]AAAGATAAAAATAGCAAAACTTATG | 1,657,676 | 87 |
| 4310. | CCATTTTATGAGAACCACTTTTGC[A,G]ATACAATCTTTTAAGGCACCATTGT | 1,658,010 | 87 |
| 4311. | ACTGATTATAGCTTTCCTCCTCTT[G,C]CCTGCCTCTCCTAACTCAAGTTCAA | 1,658,358 | 87 |
| 4312. | GGTAAGGTTTTGCCCATTACCATA[A,T]TTCTTTTATTCACATAACTATTAAT | 1,658,611 | 87 |
| 4313. | TCTTCCCCACAGCCTCCTTTGCTC[A,G]GCCACCTTATGCATAGTGGTAGCTT | 1,659,494 | 87 |
| 4314. | ATTTGGCATGGAATTGTTTCATCT[G,A]GAAACTCGACCTTACGAACTCCACT | 1,660,372 | 87 |
| 4315. | TAGTTGCTTCCGGGTCTCCTTCCC[C,T]TGTCCACCTTCTTGCCCTTTGGTGG | 1,660,502 | 87 |
| 4316. | TAGATTAGCCTTCAAGACATTGAC[G,A]AGTCAAAGAAAACTCATCTGAGCAC | 1,660,641 | 87 |
| 4317. | GGGCATGCCATTGATGCCGATCTC[G,A]ACATACATCAAGGTCCTACCTCCCA | 1,660,704 | 87 |
| 4318. | AAAGTTGTATCAAGGCAAGAGCAC[C,T]ATATTGAACTACCTCAAGAACTCCA | 1,660,982 | 87 |
| 4319. | TCCTTGCTTGCATCGTAAAAAGAA[G,A]CTTGGTACCTAAATTGGGTTTGGTC | 1,661,073 | 87 |
| 4320. | GGTTTTGCAGCTCAAGCCAGGCAC[A,G]GCCCATAAGGGCTTGGGCTAGCACG | 1,661,824 | 87 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 4321. | GTCGAGGTAGTTGTGGAATAACTT[G,C]TTCATTAAGGTGCTAAATGTAGCTG | 1,662,429 | 87 |
| 4322. | GCCATCCAAATACACCACTACAAA[C,T]TCGTCGAGGTAGTTGTGGAATAACT | 1,662,456 | 87 |
| 4323. | AAGTGCTCCACATGCTCCTCCAAC[A,G]TCTAGTTGTATATGATGATGCCATC | 1,662,500 | 87 |
| 4324. | ATTCAATCTCTTCCCAGGCAAAAA[G,A]GCATGTAGAAGGAAACTGCAAAATT | 1,662,565 | 87 |
| 4325. | GTCTCCACACCCTCAAGCAGTGAA[C,T]TACCACTACATTCTCCTTATCATGA | 1,663,022 | 87 |
| 4326. | GCAAACATTTTCCAATGGTCACTC[G,A]AAAATGAATAGTGGTTCTAGCAACT | 1,663,598 | 87 |
| 4327. | CCATTCCGATTCCGATTCCAGACC[T,C]CCCACTCCCCCCAACCAAGCACCCC | 1,663,977 | 87 |
| 4328. | GAAATCGGAATAGATATCAAAATG[A,G]ATTGGAATCAGAATCGAAATCAGAA | 1,664,203 | 87 |
| 4329. | GGTTCGCAACCGGAATCAAAATCG[A,G]AATCGGAATAGATATCAAAATGAAT | 1,664,226 | 87 |
| 4330. | AATGGGCTCCAACTGGTCGCCTCG[A,G]TCTTCTGTAGATTGTAGGAGAATTG | 1,664,325 | 87 |
| 4331. | ATTGTGTAACTTGCAAGTAGCCTT[C,G]TATTGTGAGGGCAATATTTTTACAA | 1,664,585 | 87 |
| 4332. | AACAAATAAGGCCATTGTGTAACT[T,C]GCAAGTAGCCTTCTATTGTGAGGGC | 1,664,598 | 87 |
| 4333. | GACGAAGCTCTCTTGGATTCACCT[C,A]GACCAAGGTCATCTAGCTCTCCATA | 1,664,765 | 87 |
| 4334. | CCGCTCCATCACACCACACAGTCC[G,A]CCAATATATATTCCACCTCCTTGTC | 1,664,834 | 87 |
| 4335. | AGTTTGAATACATGCAAATGTCAC[A,T]ATTTCAACGATTAAAATCCCCCTAG | 1,665,184 | 87 |
| 4336. | CATATCGAAATATTTAGATGAAAA[G,A]AAAGAAAACCATGAACGTTTTGGGA | 1,667,536 | 87 |
| 4337. | TACTCAACACTCTTGGCACTCATG[C,T]CAAGTGTCTTCATAACATGACCACA | 1,667,584 | 87 |
| 4338. | TTAACTAAGAACAGTAGTCGACAA[T,A]CTAAACTTTTTTACATCCCGTCACC | 1,668,936 | 87 |
| 4339. | CAGATGGAAATCAAAGATGAACCC[C,G]CTTTTGCGCTTCTGATGGTCGGTCG | 1,669,033 | 87 |
| 4340. | AAAAAaaTCCCTAGACGCAAAAAT[C,G]GCAACCAAACTCCCGTGGAACCAGA | 1,669,079 | 87 |
| 4341. | CAATCCAACGCTAACCCGCCCGGG[C,G]CCCAGCCAGGCAAGATAAAACAGCC | 1,670,180 | 87 |
| 4342. | ATTAAATACGGGCCAAGCCCAATC[A,G]GTGGTGCACCCTTGTGCAAAGAAAA | 1,670,430 | 87 |
| 4343. | GCAAATTTATTTGCTTACGAAGCA[G,A]ATAAATAACTATTAACTTATTAGGC | 1,670,589 | 87 |
| 4344. | CGAGGCTTTGCCTCCGAATGTCTCG[G,A]TATCCATGGAGGTCATTGAGCCTCA | 1,670,922 | 87 |
| 4345. | ATCGCCTAGTGGGTGAGTAGGCTG[G,A]CGGCTTGAGATCGGGGCAAAATCGA | 1,670,969 | 87 |
| 4346. | TGAATCAAGATTGTTAGACGTAGA[T,A]ATCAACTGTGGATTATGCTCATGTT | 1,671,045 | 87 |
| 4347. | GAGGCGGTGGAGTTGTGCGCTCTC[A,G]TTTTTGCCATCTTCTCTtTTTTTTT | 1,671,404 | 87 |
| 4348. | CACTAGTCTTCCTTCCTCAAGCTC[T,C]GATAGGAAGGTGACCGGCAGAGAGC | 1,671,645 | 87 |
| 4349. | TTTAATCCCCTACCCCCTAAAAAGT[C,T]GGAGATCATATTGATGACATCAACT | 1,671,865 | 87 |
| 4350. | TGCCGACTAGCTATGAGAGGTCTT[C,T]AGAGGATTAGCTCCATCGCTGTCAT | 1,672,334 | 87 |
| 4351. | TCTGCTCGACTCATCCCTAGACAAA[A,G]GAGCACTAAGTGGCCAAAGGGATCC | 1,672,447 | 87 |
| 4352. | GGATGAGGAGCACTAGATTGCTAT[G,A]TAATGTCCTCGAAGAGTTAGCCCCA | 1,672,515 | 87 |
| 4353. | TATGCGGCAGCTGTCATGATCCTT[A,G]GCTCGCAAACTCGCATCAGGGACAT | 1,675,378 | 87 |
| 4354. | GATGATTGATGAGATGCTTTGTAT[G,A]CTTGTGGAGAAAGTATCCATGAGTA | 1,675,426 | 87 |
| 4355. | TTTATTTTAGATTGAAATTTATT[A,G]AAGTTAATGTAAGATCATTTGAATA | 1,675,574 | 87 |
| 4356. | AATTTTGATACTTTTATTTTAGAT[T,G]GAAATTTTATTAAGTTAATGTAAG | 1,675,586 | 87 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 4357. | AATTAAATTTCGAACTGATGAATTA[T,G]ATATGCTTATTTTTTATAAATTATT | 1,675,781 | 87 |
| 4358. | ACCGCAAGATGATACATAGCTTAT[A,G]GTAAGATGATACGCAATATGATCAT | 1,675,972 | 87 |
| 4359. | ATCCTGTCAATTGAGGCTAATACG[A,T]TGACAATTATTAGTCCGAAAGATTT | 1,676,175 | 87 |
| 4360. | GATGACTTGAAACTCTCTGCTTAAC[C,T]ATGTGGAGGATCCTGTCAATTGAGG | 1,676,209 | 87 |
| 4361. | CCACCATCAATATGCATTTTCATA[C,A]TTATTCATACTCTTTCTAATGTTGG | 1,676,641 | 87 |
| 4362. | AAACACCTTGTCAATTAGACAACA[G,T]ATTTGCATTATCCAAGTCTTCATCG | 1,676,936 | 87 |
| 4363. | ATTGAATCATCTGTATGGTAATTC[G,A]GTCATGATTTGATTAAATCATCTGA | 1,677,147 | 87 |
| 4364. | TGTGGTTTCTAAGCATCATACTGG[C,T]ACTCATCTTAGTCAGATCATGTACC | 1,677,223 | 87 |
| 4365. | TTTGAAACCCACCAACTCTAGCCT[C,T]CTATCATCATCGAAAAAGTTATCTT | 1,677,917 | 87 |
| 4366. | CGAGGCCTTTGCACAGATATTGAA[G,A]CAGCATTAAAAAAAaTTTGGCCAGC | 1,678,096 | 87 |
| 4367. | AGTGACTATTAGATAAACTATACC[A,C]CCCTAGCCTATAGGAGCCTAACCCC | 1,678,163 | 87 |
| 4368. | TCCTAGATAATTTAACATAGGGTA[T,C]AAATTTATTTtTTCTTGATGAGTGA | 1,678,208 | 87 |
| 4369. | CATGATGATAAACATGTCATTCAC[T,C]AAGAAAAATTAATAAAATAAAATAA | 1,678,263 | 87 |
| 4370. | TCATATGATTTTAACCAATATTTT[C,T]GTTTCTATGTTATTCCTTCTCATAT | 1,678,322 | 87 |
| 4371. | AGAGGATTATTTCTTTTTACCAAC[A,G]TCTAGATCTATAATCATATGATTTT | 1,678,360 | 87 |
| 4372. | TATCAAAATATAGACAATTAGTGA[T,C]CAATATTCTGTGAAAAACTAATGTA | 1,678,688 | 87 |
| 4373. | GCGTATCAAAATATAGACAATTAG[T,C]GATCAATATTCTGTGAAAAACTAAT | 1,678,691 | 87 |
| 4374. | CAAAGGTATGTTGTGAGCGTATCA[A,G]AATATAGACAATTAGTGATCAATAT | 1,678,707 | 87 |
| 4375. | GGTTAACTGCTAGAGCAATTTTTA[T,C]CGACAAGATACTTTTGAGAAATGAT | 1,678,888 | 87 |
| 4376. | ATTGAATTGGCGCATTATTTAAGT[A,G]TTATCAATAAGGATTTGAGTAGTAA | 1,679,007 | 87 |
| 4377. | AATTTTGAAACTTGAGAGATTTTA[T,C]TTTAAATTGAGGAGATGTCTATTAT | 1,679,244 | 87 |
| 4378. | GATGTTCGATAGAATTTTACAATT[A,G]TTAAGTATAATAATTTATCTCCTAA | 1,679,386 | 87 |
| 4379. | ATGATATCAATAATAAAATTTTTC[C,T]GCATTTTGATGTTCGATAGAATTTT | 1,679,418 | 87 |
| 4380. | CACCATGCTATTCCTCATCAGTCA[G,T]ATATGGTAAGCTATGTAGGCTATTT | 1,679,552 | 87 |
| 4381. | ACTCGTCCGTAGGGTATCCCCAGT[A,G]TGTTCAGCAACATAGGCGGCTATCC | 1,680,120 | 87 |
| 4382. | ATAAACATGTGATGGATAATTTAA[T,C]ACATATGGTACAAATTAATTTAGCT | 1,680,276 | 87 |
| 4383. | ACTATGATGGTAAACATGTCATTC[G,A]CCAAGAAAATTAATAAAATAAAATA | 1,680,323 | 87 |
| 4384. | TGTTAATATGATATTTTTCAAACA[A,G]TACATGATCAATCCTGCTGAATTTA | 1,680,512 | 87 |
| 4385. | ATTTTGATGAATTCCATTTAGTTA[C,T]AAATATAATAGGTTGCTAAGCTTAT | 1,680,565 | 87 |
| 4386. | AGCTTGAATAAGAAAGTTATGGTC[A,G]AAATAATAAAATTGTATTAGGATAT | 1,680,740 | 87 |
| 4387. | AATTCGAACTACTTCAACTACATC[T,C]ACCTTTAAGTTAATTTCTCAAAACA | 1,680,809 | 87 |
| 4388. | CTTAAGGAGAGATGGGTGAGTGCT[A,C]TTTGCCAAAAGCATTTAAGAACAAA | 1,681,014 | 87 |
| 4389. | TAAATGCTAGAGCAATTTTTATCG[A,G]CATGATGTTTTTAGAAATAATCTT | 1,681,088 | 87 |
| 4390. | TACTTGAAATGAAAGTTAAATGCT[A,G]GAGCAATTTTTATCGACATGATGTT | 1,681,104 | 87 |
| 4391. | TATGTTGGCTACTTGGATAGCAGT[T,C]CCTCTGATTGCATCGTTCTGATATG | 1,681,706 | 87 |
| 4392. | CATTATTAGCGATAAATTTTTTGC[A,G]TCACTAATACCCTATTCTGTTGTAG | 1,682,167 | 87 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 4393. | TTCATCGCTAATAATTTTTATCGA[T,C]GAAAATTCATTATTAGCGATAAATT | 1,682,199 | 87 |
| 4394. | TGATTCATTGTAAATAATCATTTT[A,G]TTATTAGCGATATAATATTTTATCA | 1,682,422 | 87 |
| 4395. | AGAAGAGATTGAATATTATGGTGT[G,A]CTGATAGATATCATAGAACTGAAT | 1,684,647 | 87 |
| 4396. | ATAATATAGATGCTGATGATCAAT[A,G]TAGGAGAAAATTTGCAAATGATTT | 1,684,981 | 87 |
| 4397. | GTTCTAAATAATTGTAAAAAAaTT[A,G]AAGATTTCATTGACTAAGTACCATC | 1,685,131 | 87 |
| 4398. | CAATCATTCAGATCGTAACGCAGA[T,C]CGTGAATGGGATGATAATGAACTGA | 1,685,273 | 87 |
| 4399. | GAATTGCAGAAAATAGAAATCCAA[T,C]CGGAGTTGCATTTAGTTCATCGAGG | 1,685,987 | 87 |
| 4400. | AAAAAGTAAAAGATAGTACAAAAG[C,T]TTATCTTGAATTGCAGAAAATAGAA | 1,686,019 | 87 |
| 4401. | AATTTGAAAAAATATCGGGTACTT[A,G]CAAGCGAAAGTGTATTGAAGCTGAG | 1,686,205 | 87 |
| 4402. | TTGATGGTAAGTTCGATCGACGTC[T,C]GCCACCCAAGGAGTTAAGTAGAGCA | 1,686,292 | 87 |
| 4403. | CTAGTAATCACTCTTGGAGGACCC[A,G]TTACAATCAATACTTTGATGGTAAG | 1,686,331 | 87 |
| 4404. | TGATGTATATCTACGACAGTTAAT[C,T]GATGTTTTGAAGGAGCTATGGGAAA | 1,686,595 | 87 |
| 4405. | TCACCTTGAAAGTACATGAAAGAA[C,T]CATTTATTTTTATATCACTATTGAT | 1,686,675 | 87 |
| 4406. | ATTGCTTCATATTAAAATCGTGAA[T,C]CGATGGAGTCAGAAGTCATTTGATC | 1,687,242 | 87 |
| 4407. | GTATAGACAAGAAGTATAGTCGCT[G,A]GATATGGTATGGAGAGGGTCATTCG | 1,687,574 | 87 |
| 4408. | ATGGTATAGACAAGAAGTATAGTC[G,A]CTGGATATGGTATGGAGAGGGTCAT | 1,687,557 | 87 |
| 4409. | ACAGTGCTAGTCGGATAAAGTATC[C,T]ATGCAAAGATGTGTCAATATGGTA | 1,687,667 | 87 |
| 4410. | GTTGTTAGATGGATATCAACAAAA[G,A]TTGGATAAATATCAGAGATATTTTT | 1,687,775 | 87 |
| 4411. | GTCGAAATAATAAAACAATATTAG[G,A]ATATTAAAATATTTGATAAGATGTC | 1,692,796 | 87 |
| 4412. | TTAGATTTCAAACTTGAACTACTT[C,T]AACTATATCTAACTTTAACTTAATG | 1,692,896 | 87 |
| 4413. | GATTTTATAAATGCTAGAGTACCA[T,C]GATACACTTGAAATGAAGGTTAAAT | 1,693,210 | 87 |
| 4414. | TGCATGTTTGTATGTTTTGGGAGG[A,G]GGAGAGAGAGTTAGTGAGCGAGTGG | 1,693,502 | 87 |
| 4415. | TGGCAGAATTTTGCAATTGTTAGG[A,T]ATGATAATTTATCTCTTAAAGAATT | 1,693,702 | 87 |
| 4416. | TCCTATCTTCTAATGATGATATCA[G,A]TAATAAAATTTTTCTATATTTTGAC | 1,693,755 | 87 |
| 4417. | CCCTCTAGTTGCATCGTTCCTCAT[G,A]CTCTAATATATATAAGCATAGTGAT | 1,693,8147 | 87 |
| 4418. | GCACCATCTGGACTCGAATACCAC[A,G]CTATTTCTTACTAGTCAGATATGGT | 1,693,892 | 87 |
| 4419. | GTGAATCTCGTCGAGCACCATCTG[G,A]ACTCGAATACCACACTATTTCTTAC | 1,693,906 | 87 |
| 4420. | TATAGGTGGCCATCCAGTCTGCCA[C,T]TGTGTTAGCCTCCCTGAAGACATAT | 1,694,412 | 87 |
| 4421. | ATTTCAAACTCGAACTACTTTAAC[T,A]ACATCCAACTTTAAGTTAATTTCTT | 1,695,134 | 87 |
| 4422. | CTTTGACAATGTGACCACAAACTG[T,G]GGTTCCTTTATATGTGTATATGTAG | 1,696,167 | 87 |
| 4423. | AGGAGGAGAATTAAAATTCTCGTT[G,A]TCGAAGTAAGCGGAGAGCAAGTCAT | 1,697,212 | 87 |
| 4424. | CCTAGGAAGACTGAGATTAACATC[T,C]AGCACCTGTTTGACACCTACTAAAA | 1,697,644 | 87 |
| 4425. | CAAGACACATGGATTATGATTCT[T,G]TTTACCTAACAATCATCCTAAGGGC | 1,697,815 | 87 |
| 4426. | GCATGTAGTGGTGAGATGCACAAT[A,C]AAGGAAGAGTCACAAATTGCAAATT | 1,698,462 | 87 |
| 4427. | TTACAGATAATGATGAAGAGATAT[T,A]TGAAAGGCATCTGATAGGGGTGGAT | 1,698,525 | 87 |
| 4428. | TGGCATATTGACTTTTTATTCATC[G,A]ACTGATTATGTGAGAAAGCATAAAC | 1,698,610 | 87 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 4429. | TGTATCTACAAACAAGCTACAAAG[C,T]ACATCAACTAGAAGAGGTGCATGTG | 1,698,737 | 87 |
| 4430. | ATTAGTTTTCTCAGTAAATATTCC[A,T]GGTAAATAAAATCAATTCAGTTGTC | 1,700,288 | 87 |
| 4431. | ATTGAAATTTAACAGATCAAATGA[C,G]AAGTGCATTGCTACTAGATTCTTCA | 1,700,782 | 87 |
| 4432. | AATTGGAGATCCTTGAACATATAC[A,G]GTAGCTTCTAAAACACCACTATTTT | 1,700,885 | 87 |
| 4433. | TTATTGTTATCTGATGGGCCCTCC[G,C]CCCTTTTGTTCTGATAAGTCATTGG | 1,701,721 | 87 |
| 4434. | ATAGTTTCACCAAGACAAATTCTG[A,T]ATCAATAAACCAACGATATATAATG | 1,702,011 | 87 |
| 4435. | CAATTATGAAATTAGAAAGTTATT[T,C]TCTATGCTTGAAGTTCTCTAGTTTC | 1,705,974 | 87 |
| 4436. | ATGTTTGAGGAAAACAAGTAGTCC[T,G]ACAATTATGAAATTAGAAAGTTATT | 1,706,000 | 87 |
| 4437. | TGTACCACCAAGTTGCATATAACT[T,C]TAGAGTCAAGTCTAATCTGTATGTT | 1,709,089 | 87 |
| 4438. | TCTTGTCCTGATAATTTCCTTTAA[C,G]ACGTTAATTCCAGCAATTAACTACC | 1,706,507 | 87 |
| 4439. | TCAGCTCACATCGTCATGGTACG[A,T]AGGTGGTGTAGAAGCCTTCTCCAAT | 1,706,729 | 87 |
| 4440. | AGTCAGCTCACACTCGTCATGGTA[C,T]GAAGGTGGTGTAGAAGCCTTCTCCA | 1,706,731 | 87 |
| 4441. | ATATAAATCCATAACAGTTTAGGA[T,C]GCAGAATACTCTTGATGCCTGGGCA | 1,706,843 | 87 |
| 4442. | GTCTATTGCGAAAAGTGGGTCAGT[C,T]AGATGGAATTGAGAAAACATTTGAG | 1,706,928 | 87 |
| 4443. | CCAGGTCAGCCTGTCTGGTTGTGT[C,G]AATCCAAATAAAAGATTTGATGTAG | 1,707,048 | 87 |
| 4444. | AGCACGTCCAGGTCAGCCTGTCTG[G,A]TTGTGTCAATCCAAATAAAAGATTT | 1,707,055 | 87 |
| 4445. | TAAGGTTTCTGAGCTTCTTGTTAC[T,A]GTTTGTATTTCATTTCCTAAAATGG | 1,707,122 | 87 |
| 4446. | GCTTTAGCTAATTATGCTATATAT[T,A]TTTTtAGATTAACTGTTGATTCTTG | 1,707,191 | 87 |
| 4447. | AATCCAGTTACCATGTTTTTGAGA[C,T]GTGCTATTGTAAAAGTTGAGGAAAA | 1,707,479 | 87 |
| 4448. | TTCCATTGATGATTGGTCCATCAT[A,T]CAAGATTGTCTGCTCGTGCATATGC | 1,707,970 | 87 |
| 4449. | CAGTTGGGCTACATTGGTCTTGGC[A,G]TAGAGTTTTATCTCCATTATACTCT | 1,708,567 | 87 |
| 4450. | ATTTTGTGGATAGTGAGGGATGGG[G,A]AAGCCACTCTTGTATGAGATTTGGG | 1,708,829 | 87 |
| 4451. | TGTGCTGAGGTTGGAAGTCATAAT[G,T]TTGCGACTGATTACGCAGTCTTGGG | 1,709,305 | 87 |
| 4452. | GAAAGCTGTGTTGATTTGGAAAAA[A,T]TTCCTCTAAAGAGATTCTTTTTATC | 1,709,396 | 87 |
| 4453. | ACCTCAATCAGCCAATTCGATTTA[C,T]TGTCTGGAAGATAAGAATGTGAAAG | 1,709,441 | 87 |
| 4454. | TCCGGACAATTTTGTTGGATGAGA[G,T]ACTTGCACAACAGCCATATATTTAG | 1,714,587 | 87 |
| 4455. | TTTGTTGGATGAGAGACTTGCACA[A,C]CAGCCATATATTTAGTTATGTTGCC | 1,714,597 | 87 |
| 4456. | AAGCTAAAATAGATATTTAGATCA[G,A]TTAACTGCTCGCAACCGATGGCGAA | 1,714,657 | 87 |
| 4457. | TTAGCTATTGTAGGCTCAAATTTA[C,T]GGGCAAGCTGGGTGCATGGCATGA | 1,714,892 | 87 |
| 4458. | ATGCCCATCTCCTCTTGGAATTTC[A,G]TCTGGCAACGAGCATTCCCCACCAT | 1,715,211 | 87 |
| 4459. | ATCGGGGTCGCAGGTATCTGTGTC[C,G]GGGCACCCGCAAGCACAGGAGCTGC | 1,715,757 | 87 |
| 4460. | GTCCATGGTTGGTGGTAAGAGGGT[A,G]CCATTCTTACAGCAATAAGGTATCT | 1,716,105 | 87 |
| 4461. | GTTACTCGACTTTTCAAAACTGTG[G,A]ATCTTATTTAACTATACCTCTAGTC | 1,721,227 | 87 |
| 4462. | CTTATTTAACTATACCTCTAGTCA[T,C]CAAAGTGGTCCACATAAAATTTGAT | 1,721,254 | 87 |
| 4463. | AACTATACCTCTAGTCATCAAAGT[G,A]GTCCACATAAAATTTGATGATTCTC | 1,721,261 | 87 |
| 4464. | GGTGAGCTTCACAATATGCCATGT[A,G]TCCCTTAATACTAATCTTAAAGTAT | 1,721,402 | 87 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 4465. | CATTTTAAAGATCTTAGCTCCCTT[C,A]TGTGAAGTTGAAGTTGGTTGATTGC | 1,722,661 | 87 |
| 4466. | TCTAGATCCGATCCTTCTTATCTC[T,C]CCAAAATTTATCTAAGTTTTCACTA | 1,723,087 | 87 |
| 4467. | GAAACACATATAGTGTATGACTTC[C,T]ACGTTATTACAGATTCTAATTGAGT | 1,723,351 | 87 |
| 4468. | TCATTATCTATTGATCTCTGGTTT[G,A]ATGGTGGATCAGCATTACATGGGTT | 1,723,854 | 87 |
| 4469. | AATCTGAATTACTACGTTTGATAT[A,G]TTTTTTTGGATGGTAATCCAGATTA | 1,724,043 | 87 |
| 4470. | TATATTTTTTGGATGGTAATCCA[G,A]ATTATCTTAATAATTTAATTGAAAA | 1,724,064 | 87 |
| 4471. | GCTAATTATACTTTCGTCCTTTGA[G,A]ATTTTTTATTGTATGAAATTTTTA | 1,724,468 | 87 |
| 4472. | CACCAAGCTAGTAGACCAATTAAA[C,T]TTGAAAGCAACACTACCCTAGCTCC | 1,724,534 | 87 |
| 4473. | CTATATCTAATGACTAATAGTTTC[A,G]AGGCATATTTTAACAAGCTCAAGA | 1,724,726 | 87 |
| 4474. | CTTTTGATAAAAACTTGTAGGCTC[G,A]CAAGGGCCTATTAAGATGACTAGTA | 1,724,810 | 87 |
| 4475. | TATGTTGAAACCGAATATCCACCA[A,C]GGCTTACATAAAAATTAAATGGCAC | 1,736,030 | 87 |
| 4476. | TTTGCATCATTTGATCATTCCTAC[T,A]GTGTTCTGGTGATATCCAGTGGGGG | 1,736,416 | 87 |
| 4477. | CTCTTTGACTTCAATCTGTGCTTC[C,A]GAGATGAAACGAAAAGGTCATCATA | 1,737,193 | 87 |
| 4478. | GAAAAGGTCATCATATATTAAACATC[A,C]ATTCTTAATCTCCACCTTTCCAGGT | 1,737,228 | 87 |
| 4479. | TTGGAGGATTGCTCGCCAGTAGCA[T,C]GAGTACCTGGAAGGAAGATCTTCTT | 1,737,289 | 87 |
| 4480. | CTAGACATAAGAGCTCAACTTACT[T,C]ATTACCACATCCGAATCCGCTCCAT | 1,737,545 | 87 |
| 4481. | AACCTGGACGAATCATACTAATCC[G,A]AAAGGCTGAGATCCCATATGGATCA | 1,737,648 | 87 |
| 4482. | AAAATTTAACAGAGACTAAAGATG[A,C]CCCAAAACAGTGGACATTGACTTGA | 1,737,948 | 87 |
| 4483. | ATTACAGCCAAAAGAAGACATACC[G,A]AAGCTTCCAGAAGCAGGTAGTGGCA | 1,738,040 | 87 |
| 4484. | GAGCAAAAATTCTTCTACATCAAC[G,A]ATCTAATGGTGGTGCAACCTGGAAA | 1,742,280 | 87 |
| 4485. | CCAGAACAACCATTTGACAATTTA[C,T]CATGAGAAAGTTATTTGCTGATCTC | 1,742,608 | 87 |
| 4486. | TCTCAGAAAACTCTAAAGAAAGCC[A,G]AaTATAAATTTTAGACCTAGATTCA | 1,743,060 | 87 |
| 4487. | ACGTAATTCGGTCAGCAACTCTGC[G,A]CTTGTTTCAGCATTGTTAGGACTGG | 1,743,358 | 87 |
| 4488. | AAGATTTACTTTGTCAACTGGGAA[A,T]ATGCCATGAACAACATATACACCTT | 1,743,569 | 87 |
| 4489. | TTTTGTTGTAGTTCAAGCATGATG[G,A]GATGGGTTTCAAAATGAGTCTCAAC | 1,743,821 | 87 |
| 4490. | AaGGTATGAGCCATTATTGAGTTA[C,T]AAATGAGCCACAAATCAAACAGATC | 1,744,027 | 87 |
| 4491. | TAAGCTTCATGCATCAGCTCAGAT[A,G]AAGGAACCAAGGAAAAGAATGAAAG | 1,744,167 | 87 |
| 4492. | GAACAGACGTACAGTTGGTAGCTA[A,T]GCATTATATTGTGGCAATGAAGGAA | 1,744,566 | 87 |
| 4493. | TGCTTACAAGTTGAGCCTATAGCA[T,A]GAATGGATGCAACTCTACTCTACCA | 1,746,019 | 87 |
| 4494. | ATTAGCCGACAAATATTAATTATT[A,C]TGAGACCGGCATATAAGAAGTCTAA | 1,747,911 | 87 |
| 4495. | GCAGATATGGAAGACTGATCCAAG[T,A]ACcGCTAAAACCAGATCATTCGAGT | 1,748,046 | 87 |
| 4496. | GATATGGAAGACTGATCCAAGtAC[C,T]GCTAAAACCAAGATCATTCGAGTAGA | 1,748,049 | 87 |
| 4497. | GTAAGTTCCGACCACTCACCCTG[A,C]AAAAAGGTGGCAACTTTGAGATGCT | 1,748,288 | 87 |
| 4498. | CTATGCATTGACAATATGAAATTA[C,T]TACAGATGTGTTTCGATTAACAATG | 1,757,258 | 87 |
| 4499. | TTTATCCATCCGTTGTTTGGTTTG[G,A]CTTTACCATCGAGTTCATCTATTCT | 1,757,837 | 87 |
| 4500. | TTGAAAAGCAAAAATAAGGCACTC[A,G]GACATGATAATAATATTATCATTTA | 1,758,074 | 87 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 4501. | ACGAACAAGCACCGATAGATATTT[T,G]AGTGTAAACATGCTCATGTCATGTT | 1,758,152 | 87 |
| 4502. | TTGTTTTGTGGGAGAAAAGGCTTT[G,C]CATCTGAGCCTGACCTTTCATCTGC | 1,758,355 | 87 |
| 4503. | TCTTTGCCTTTATCCTTGGATTTC[T,A]GCTCTACTTAAATGGTCTTACTAGA | 1,759,719 | 87 |
| 4504. | TGTAATATATTTCTATTGCCCCCC[G,A]TGTATTTGTTACATGATGGACAAAT | 1,760,495 | 87 |
| 4505. | AAACACTGAAAATTAAATCCCAAG[T,C]AGACCGTTAGCATCTACTGGATATC | 1,766,861 | 87 |
| 4506. | GATAGTATACATCTTTTTCCATAT[A,T]CCTAATAATTAAATGAACATTTCTC | 1,771,974 | 87 |
| 4507. | ACACAGTCTTTATATTCTTTCCTG[C,G]TCATTACTCTGTTATATTTCTTTAC | 1,772,033 | 87 |
| 4508. | TAATGTTAAATCCCATATCTGTGA[G,A]ACTTGTTATGACAACAATCGAACCC | 1,772,152 | 87 |
| 4509. | ACACCATCAGTTGCAAAACTGAAA[G,A]AAATTGAGTAACCATTGAGGGTTAG | 1,772,334 | 87 |
| 4510. | AATCTTTGTCGCTGCCTTGGGATG[T,C]TTTAGCACGAATCCTTCGTCCATCA | 1,772,414 | 87 |
| 4511. | TGCCTTGGGATGTTTTAGCACGAA[T,C]CCTTCGTCCATCAAGAATAGCATGG | 1,772,426 | 87 |
| 4512. | TAAATAACCAGACATCCAAGAAAA[C,T]AGAAATCTCTTCAAACCCATCCAAA | 1,772,536 | 87 |
| 4513. | TTATAAAAAATTTATATCCATATC[C,T]GATTGGATCGGATGAAATTTATTTA | 1,773,207 | 87 |
| 4514. | AGATCTTATCTTCTAATTTTGTTC[A,G]TCTGTCTTTTGCTTTCGTTGATTT | 1,773,531 | 87 |
| 4515. | TTTTTTtATAGGAGTCTCAATCAA[G,A]AAGAGGTGTGAAACTTTTTtGGTTT | 1,773,612 | 87 |
| 4516. | CAAGACATAGGAAGTCATAATAAA[C,T]CGATAAAATATCATATAAAAATACA | 1,774,443 | 87 |
| 4517. | TATATTAGCTCGGCTATATCGCAC[A,G]GTTGGAATGATTGTCACCACATGCA | 1,775,021 | 87 |
| 4518. | TTCCCAATAATAGACTCCAACCCC[G,A]TTCTATATATAAGAGCGATTCGAGG | 1,775,114 | 87 |
| 4519. | ATAGTTTGGATTTTAGCAACAACA[C,T]ATCTCAACAAATGGCAAGGATGGTC | 1,775,304 | 87 |
| 4520. | TGACACTCTATCTATCCATCTGCT[T,C]ATCCGTAAAATCCAAGCCATAGTCAA | 1,776,580 | 87 |
| 4521. | ATCATCGATTTCTTTCTTCTCTTG[A,T]CCTTCCAACAAATTTTATATGTAGA | 1,779,615 | 87 |
| 4522. | TCCATCTTCTATATCAGTTCGAGT[G,A]ACAATATTAAATTTTAAAAATATGA | 1,779,684 | 87 |
| 4523. | TTGCTGCGTACTCTGATTTTAATT[T,C]ATCAAATTATATAAGTCTATTAAAG | 1,779,957 | 87 |
| 4524. | AAAAACTCAAGCCAACATCCTTAA[A,G]TAgAATCAACTTGATTATTTCTTAT | 1,780,304 | 87 |
| 4525. | TTGACTTGAATAATTAATACACCT[C,T]ACCATCTTCAACAATCACAAGAAAA | 1,780,487 | 87 |
| 4526. | ATCAAGGAATCATATTCAGAATAT[G,A]ATATTTTGAGTAACCAAAGATTTCA | 1,780,718 | 87 |
| 4527. | AGACCAAAACAATAATGTAATTTT[A,G]AAATATTACATGGCTATTTTAGAAA | 1,787,842 | 87 |
| 4528. | TTTCCATTTTCACTGGATGAAAAC[A,G]GTGGAGGATTATGTTAGGCTGACAG | 1,788,406 | 87 |
| 4529. | CCTTCATCTGCAAGAAAAAAGTAA[C,T]CTATGATAATTAACGTGTTAATGCA | 1,789,793 | 87 |
| 4530. | AAAGTAACCTATGATAATTAACGT[G,A]TTAATGCATAATGGTTATGGTAGCA | 1,789,810 | 87 |
| 4531. | AAAATACTAAGAAATCCCATTATT[T,G]TTTAACAAAAAAaCAGCTGCGCTTA | 1,789,929 | 87 |
| 4532. | TTCGTTCCAGAAAATTATGTTCCT[A,C]GAGAACTTTTTCTTCAATGCTAACA | 1,790,225 | 87 |
| 4533. | GACGGCAACTGTATAACGCTATAA[A,C]ATAAGAAAATATAACAAAGATAAAC | 1,790,331 | 87 |
| 4534. | AATATAACAAAGATAAACAAATGC[T,C]CCACATCCACAGAAAgAGAGAGAGA | 1,790,363 | 87 |
| 4535. | GACGCGGTCTGAGCCACTCGTTAC[A,G]AGAGAGAACAAATGAGAACCTTTTG | 1,790,538 | 87 |
| 4536. | CCGACAATCTATTCAGATAATTGA[C,T]AATTTAAAATAGACTTATCAAATTA | 1,791,054 | 87 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 4537. | TTTTCCTGCGGTGGCTATCATGTC[A,T]ATAACTTCTAGATGCTGTTTTCTTA | 1,800,705 | 87 |
| 4538. | CTTCCTTTCACTAAGAGATGCAGT[T,C]GGCTGTTTTCCTGCGGTGGCTATCA | 1,800,735 | 87 |
| 4539. | GTGCTCTGTCAGCTTCACTTGCAG[C,T]cTTCTCTGCCTCCCTTTGGCACTGC | 1,801,372 | 87 |
| 4540. | TTCCTCAGATCGAAGAAGCCTTTC[A,G]TACCACCAATCACCATCTTTTTCCT | 1,801,614 | 87 |
| 4541. | AGACCAATTATACGTGCCTTCTGC[A,G]TACCACCAATCACCATCTTTTTCCT | 1,801,659 | 87 |
| 4542. | ATAGTATAACATAGATGTGAAGCA[T,C]AGACCAATTATACGTGCCTTCTGCa | 1,801,684 | 87 |
| 4543. | TTCCAATAGCATAGCATCAGTTGA[T,C]GACATCTTTCGCAATTAATGTTATG | 1,801,785 | 87 |
| 4544. | AAACTTATCAGGTTATAAAGAATT[A,G]AaGATTGAAGTTTCTTTTAATGCTT | 1,802,612 | 87 |
| 4545. | AACTAGATGTCATTCTCACCAGTC[A,G]CTTTGAGATGTGAAGCATTATCTGC | 1,804,403 | 87 |
| 4546. | ATTTAGTCGAAAGCTGTATTTCAT[T,C]ATAACCTAATGACAAAAATGAATCA | 1,805,534 | 87 |
| 4547. | CCAATTCTATACCAGTAtACAGTA[C,T]AGGAGGCGAACCAACACTCGGTACG | 1,805,766 | 87 |
| 4548. | TACCGTACCAATTCTATACCAGTA[T,C]ACAGTACAGGAGGCGAACCAACACT | 1,805,773 | 87 |
| 4549. | ACATGTTACACCACACCATACCGA[T,A]CCATGTGGTATGGAACCTACCGTAC | 1,805,815 | 87 |
| 4550. | CAATGTGCATTGGAGGTTCCTTTA[A,G]GATTCCTCCAGAAACAGGAATATGG | 1,806,013 | 87 |
| 4551. | ACTCCACATTTTGTTATTCACAcT[C,T]ACTAGCGAATATCAGCAAATCAGGT | 1,806,206 | 87 |
| 4552. | TAACTCCACATTTTGTTATTCACA[C,T]TcACTAGCGAATATCAGCAAATCAG | 1,806,208 | 87 |
| 4553. | GATGGGCAATTGCCTGCTCACCCA[T,C]AGTACATGAAACTTGTAGATATGCA | 1,807,608 | 87 |
| 4554. | GGTTCTCACTAATCAAGATTGTT[A,G]TACGGCCAACCAATTATAGAAGGTA | 1,808,014 | 87 |
| 4555. | TCGAGTGACTATGAGCGTAATTGG[T,G]AAACCTTCGTCCTTATCCACAGCAA | 1,809,638 | 87 |
| 4556. | TCaCATCATTTTATGTTCTTTTCA[G,A]GAAAAGTATATGGTTCAGGCAAAAG | 1,810,035 | 87 |
| 4557. | AaTACATGGGCATGGAGCAAGATC[A,C]CATCATTTTATGTTCTTTTCAGGAA | 1,810,057 | 87 |
| 4558. | AATGCAATTGTTCTTAGGCAAAAa[G,A]AAAAaTACATGGGCATGGAGCAAGA | 1,810,085 | 87 |
| 4559. | CATACTGACAAAGAAACAACTTGC[A,C]aTATAAATTTAGTGTGCTTTATTGA | 1,810,147 | 87 |
| 4560. | TCCCCCCAAGAAACTTATAGAAAT[C,T]cGCTATCTAGATGGGATATTTTAAT | 1,810,238 | 87 |
| 4561. | TAGTGCTTGATATTTATTTTAAAA[C,T]TTATATTATAATTTAATGTTTAACA | 1,810,313 | 87 |
| 4562. | TTGTTTATATTCAACCTCAAAAAC[C,T]TAGCTGATGTATAGATCATTTATTA | 1,810,929 | 87 |
| 4563. | ATTTTtATTTAGATAATAATAAT[T,A]ATTATTTTTATTTCTAGCTATGTCA | 1,811,018 | 87 |
| 4564. | TATTTATTGTAATAACCATCATCA[G,T]CCTCATATCATCACCACCGTCATCA | 1,811,406 | 87 |
| 4565. | TGCGCGCGcgcGTGTGTGTgtg[T,A]GAGAGAGAGAGAGAAGATCAAATAT | 1,811,453 | 87 |
| 4566. | AGAAGGGGATAGAAGAGGGAGTGA[C,T]GGGGGTCCATGGAAGCCAAaTGAAT | 1,811,513 | 87 |
| 4567. | AAAGAACAACAGTGAGTGAATTTG[C,T]GACAGAAGGGGATAGAAGAGGGAGT | 1,811,541 | 87 |
| 4568. | CCAATTCAGTTTGTTTAATTTTGA[G,A]CCAGCTCGAGTTTGGTCCATGTAGC | 1,811,636 | 87 |
| 4569. | ATCATCTGTGCATAGAGGAGGTCT[C,T]GGGCACTTGAGCAAGGCAAAGGACC | 1,811,946 | 87 |
| 4570. | CAAGCAAACTATCATCTCATACTT[C,A]GGTATTGAAACTGAGAACAGCGATA | 1,812,346 | 87 |
| 4571. | TGTCTTCACGAATTACTTATGGTC[T,C]AGCATATGTCTATTATGTTGAGTCC | 1,812,414 | 87 |
| 4572. | GATGACGATGATAACAGAACTTCA[G,A]TGCACCTAAAAATATGGATAAACAT | 1,813,044 | 87 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 4573. | AAGTAATAATGTAATAGATCCCTG[T,A]AATGCATCAGGCAATTAAAATCAAG | 1,813,181 | 87 |
| 4574. | AAAATAATATTATATGCCTGGCTT[A,T]CATCTATCACAGATAACTAATTAAA | 1,813,298 | 87 |
| 4575. | CCAACTAGCATCCAGAAAACGTAA[T,C]GACATATGCAGTTTGCAAAGTTTAC | 1,814,046 | 87 |
| 4576. | GACcACAAAATTATACAAGTTAAG[T,G]TtGCATTTAGCTCATTGTCAGAAAA | 1,814,109 | 87 |
| 4577. | TGTCAAAAGTGAGCACCACAGAC[C,A]ACAAAATTATACAAGTTAAGTTtGC | 1,814,130 | 87 |
| 4578. | GCAAACTTTCTGGACAGAAAGCTT[A,C]TTGTTTGTTCTGAACCCTAGGATCT | 1,814,292 | 87 |
| 4579. | CCATTAATTATATTAGCTCATCCC[T,A]AAAAACATCAAATATTCTACCTAAC | 1,814,384 | 87 |
| 4580. | CTTGGTATGCCTCAGCACAAAAAG[C,T]GGTACAAGATGGTACGGGGCCTGTA | 1,815,917 | 87 |
| 4581. | CTAAAGTACACTTCTAATTTGGTG[C,G]cTCAAACTCATAAAACTCTTTCGCA | 1,816,277 | 87 |
| 4582. | ATGAAGGTATAATAGCATTAAAAG[A,G]GTTTTGGCAGAGTTGTAAGTGTAAG | 1,816,826 | 87 |
| 4583. | TTACAAAAAAaGGGTCCTTCATC[A,T]ATGGAAAACAAATTGTAACAACCTG | 1,817,617 | 87 |
| 4584. | TCCCAGTTGGTCTTGGTTTCTACC[A,G]aGCATCACATGGACTGAACCAGCCA | 1,817,917 | 87 |
| 4585. | ATAGAATTTTAGTAGACCATGTTC[A,G]TATTCCTAAGGTCTTGCCAAGTTAA | 1,819,010 | 87 |
| 4586. | AAAgAATCAGTATTTCTGTTAAAa[C,T]cATATACGGAAGTCTGACAAGGAAG | 1,819,075 | 87 |
| 4587. | AATATTCTTCTCTAACAAGAAAAA[G,A]AATCAGTATTTCTGTTAAAaCcATA | 1,819,096 | 87 |
| 4588. | TGATGGAACTAAGGGAACTGGAAG[C,T]GAAATAGCAACTCATATAAATAGCA | 1,819,268 | 87 |
| 4589. | tAAAAAGCACATATTTTGGAAAAC[T,C]tAAAAGATTACCAGCAGAgAGTAGA | 1,819,652 | 87 |
| 4590. | AAACGGAACGATGTTTTAATTAT[T,C]TtAAAAAGCACATATTTTGGAAAAC | 1,819,678 | 87 |
| 4591. | CTTAACCATCAATCTGACATAGCT[A,G]CTAGAGAAACAGAAGAAAGAAGTT | 1,819,841 | 87 |
| 4592. | CTGCCAATGAAAGAATATGAGGTG[A,G]ACAAGCACAAAGGATTTACAGGTGAC | 1,819,897 | 87 |
| 4593. | AAGAACAGATCTGACTTATCAGCA[C,G]TATATTTCTTTATTCTTGCATTATT | 1,822,088 | 87 |
| 4594. | GTGGTTAAGACCTTAGAGATCACT[G,A]TGGTTTCGATTTCCATGGTTTCGAT | 1,822,311 | 87 |
| 4595. | CTGTGATTGTCTGTAGAAAGAGGC[C,T]GAAGAGAGTCGAGAATTTTATATTT | 1,822,561 | 87 |
| 4596. | ATAATAAGCACATCGTGCATCACA[A,G]GAATCTGAAAGGGTATTGTTTTGAA | 1,822,881 | 87 |
| 4597. | ATACgAAAAGTCAGTATATCCAAA[T,G]ACAAACAGAAGAAAAAGAATAATGA | 1,822,937 | 87 |
| 4598. | ATGCAATGATGCCAAGAATGATAC[G,A]AAAAGTCAGTATATCCAAAtACAAA | 1,822,957 | 87 |
| 4599. | AAAATTACATATAACAGACACAAA[A,G]TCCAAGTTATATATAAGTTCATGGG | 1,823,210 | 87 |
| 4600. | CATATACGAATAAAATGAACAAAG[C,T]ATATAAAAATGTGACCATAGAATAA | 1,823,534 | 87 |
| 4601. | AAAACTAAGTATGGCATGTACCgC[G,A]gTACACCTCCATACATACTCATGGT | 1,823,970 | 87 |
| 4602. | TCAAAACTAAGTATGGCATGTACC[G,A]CGgTACACCTCCATACATACTCATG | 1,823,972 | 87 |
| 4603. | ATCACATCATGACTGTGTTAGGCT[T,C]GTTCAGTTTAAATAACCAAGTGGTG | 1,824,164 | 87 |
| 4604. | CTGCATTTCCTACAACGCCTTACC[A,G]TTCTAAGGAATTACATCTCATGCTA | 1,824,275 | 87 |
| 4605. | TATTTAAACTCATGACTTGGTCTA[A,G]ACAATTTAGCCAAGTGTCAGTAACT | 1,824,574 | 87 |
| 4606. | TAaTTGAGGCATCTCATGTGTCCC[C,T]TGACAACAATCACATGCACCCATTA | 1,824,633 | 87 |
| 4607. | GAGCTTCAAGCTGCACAAATTGCT[A,T]aTTGAGGCATCTCATGTGTCCCcTG | 1,824,656 | 87 |
| 4608. | GTTGAATCCAAATTgCATATCTGT[G,C]TCCATGCCTCAAAGACCATGATTAG | 1,824,745 | 87 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 4609. | ATCTACATATGTTGAATCCAAATT[G,A]TCCATGCCTCAAAGACCATGATTAG | 1,824,755 | 87 |
| 4610. | GGAAAAGGTGGGAACTAGTAATAT[C,T]ATATCACATTTTTTATAGGAATTGC | 1,825,267 | 87 |
| 4611. | GAAGATACGaCCAAGTCTTGCCTA[T,A]tCACCATTGCTCCACTGCACAAAGA | 1,825,463 | 87 |
| 4612. | CTCGCAATCTTCTCTGAAGATACG[A,G]CCAAGTCTTGCCTATtCACCATTGC | 1,825,478 | 87 |
| 4613. | CACATGCTACACATGATAGTTATA[A,G]GCCATTGTAATGATACATCATCTGC | 1,826,046 | 87 |
| 4614. | TGAGAACATGAGTAAGTTGGTCAA[T,A]AAAAAAGTTGACCAACTATCCCATG | 1,826,253 | 87 |
| 4615. | ATGAGGAAGTAACTTATCCATCCT[T,G]AAAAGTATGAGAACATGAGTAAGTT | 1,826,285 | 87 |
| 4616. | TAAAGATATATTAAGAATGAATTA[C,T]AGAGGTTATTTTTTCGATTGATGGA | 1,826,399 | 87 |
| 4617. | TTCTATATTATATTATATTATTAT[C,A]TAATAATATTTATATAATATATTAT | 1,826,493 | 87 |
| 4618. | GTAAAAGATTTTGTATTGCTAAGC[G,A]TAACATGGTATAAGCATCACTAAAA | 1,834,430 | 87 |
| 4619. | AAACATACTGTCAACACCAGTCCC[G,A]GATTTTTCATTCCTTTTTGATACTT | 1,835,096 | 87 |
| 4620. | ACCTGACCTATCAGTGCATACTGA[T,C]GATTTTTCATTCCTTTTTGATACTT | 1,835,155 | 87 |
| 4621. | GAAATAAAGGAAGTTCACAAACTG[C,T]TTAGTCTGGTCTAACATCCTTTTTC | 1,835,871 | 87 |
| 4622. | GCAAAATGCAAAGGGTGACCTCTT[A,C]TCCTCAAATCTAATATGCCTATATG | 1,836,268 | 87 |
| 4623. | AACATATTAGAAAATAGTTTGCAT[C,T]ACAAAAATCCTCAGGTTCGTTACAT | 1,836,788 | 87 |
| 4624. | CTTATAATTAGCCAAAAAAAAAAa[T,A]CTTAAGAATGATAACATGCCAGTAA | 1,837,586 | 87 |
| 4625. | TAGAAGATGCACAGCCTAATTATC[T,C]TGATGAGATCCATTAGATAAATTAA | 1,838,522 | 87 |
| 4626. | GTGGGATAAAGGCATAAAGCTGGT[C,T]GAACCATCAGTTTACAATTGCAATT | 1,838,574 | 87 |
| 4627. | TCTCCGAGGTAGAGAAGAGTGCCA[T,C]CAATGTGGGATAAAGGCATAAAGCT | 1,838,603 | 87 |
| 4628. | TCGTAACAAGCGATTAGCATAGGA[A,G]AATTTAGAATTCTCCGTTAGCGTAA | 1,838,693 | 87 |
| 4629. | TTCGTAACAAGCGATTAGCATAGG[A,G]AAATTTAGAATTCTCCGTTAGCGTA | 1,838,694 | 87 |
| 4630. | CTTTATCTCCTCACCTTGTTAATG[T,C]GGAGAAATTGGTGAAAGGAATTCCT | 1,838,896 | 87 |
| 4631. | TTTTTACCGAGCTTTGAATTAGCT[T,C]TATCTCCTCACCTTGTTAATGTGGA | 1,838,918 | 87 |
| 4632. | GCGAACCAGAGAGAAACTAGAAAC[C,A]AGTGGATTCCGGTGAGAGTCCACCG | 1,842,855 | 87 |
| 4633. | ACATCAAAGATTAGCATGAGATGC[C,A]GCTGATTGTTTTCAGCCGTGGTTCA | 1,843,255 | 87 |
| 4634. | ACAAGTCCAGATAATTTATGCCGC[T,C]CCTTCAGCCAGTACAGCATAATCTA | 1,843,493 | 87 |
| 4635. | GTGTGTGTGTGTGTGtaTGTATGT[A,G]TGTGTGTGTGTTTGTGCAGAAAGCA | 1,846,206 | 87 |
| 4636. | aGGTTTAATTAAAGTAATTAGAAC[C,A]TCAACAGTTAAAAGAAAAAGGGGAA | 1,847,598 | 87 |
| 4637. | ATAAAGAACATGTAGCTCTCTCTC[A,G]AaGCAGATGGGCAGCATGTTCGACC | 1,848,084 | 87 |
| 4638. | TAATCCTATTGACTTCAAGATCTT[C,T]CcAATTAAAGGATTCAAATGCTAAA | 1,849,179 | 87 |
| 4639. | GGAGACATCATCTTCTAGTGGCTA[C,A]TATCCTGTGCAATTCGGAGCGTCTT | 1,850,297 | 87 |
| 4640. | TAGCAGGAGTCAGAGCTTGAtGAG[C,T]cAGAATCGTCTCCACGACCTGCCAG | 1,850,912 | 87 |
| 4641. | TCAGTAGCAGGAGTCAGAGCTTGA[T,C]GAGCcAGAATCGTCTCCACGACCTG | 1,850,916 | 87 |
| 4642. | CCAACTACGAGTGATTTTATTAAT[G,A]AAGATGAAGATCCGATGATCGGATG | 1,850,975 | 87 |
| 4643. | CAAATGTATTGAGAAGGAAGTTCA[G,A]ACTGAAGTACTCAGATCCAACTACGA | 1,851,015 | 87 |
| 4644. | CTAAAATAGGAATGCCATAATGAT[C,A]TTGTGTACGTGCATTATAATTTGAG | 1,851,074 | 87 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 4645. | GGATTCGCATGAAATTTGAAAGAC[T,C]TtGCCATCAAGATCCTCTTCCAGAC | 1,851,194 | 87 |
| 4646. | GTTCAATGATATTTATTAACTTAG[C,T]TGTATCTTCAACAGCTAAGATTTTA | 1,851,443 | 87 |
| 4647. | GAGGGGAGCAATGTGGAGAGCTTA[G,A]TGACGAGACAATCAGCAGATCGTGA | 1,851,917 | 87 |
| 4648. | TATATTGAGACCAGAGATGTCACA[A,C]GATTTGCTATTAATTATATAGCACT | 1,851,055 | 87 |
| 4649. | GAATCCTTGATGCCAAAATTGATG[T,A]AGAAAGGTACTAGCAACAACAATCA | 1,862,549 | 87 |
| 4650. | TCCCCCATGACTGATACTTTACAT[T,C]TTTTATGGGCTGCAAACACTTTTAT | 1,864,734 | 87 |
| 4651. | GCATGGAACGTGTTGCGAGGAAAA[T,A]ATATACTTTTCAGGATGACAATGAG | 1,864,816 | 87 |
| 4652. | TATATAGTTCAGCATGGTATGAAA[C,T]AGCATATCGACGATCGGCGTGGTAC | 1,865,003 | 87 |
| 4653. | TTTCTTTGATTTTTTTAATCCTTT[T,C]TtCTAACCAAAACTCTGAATCTTGA | 1,865,202 | 87 |
| 4654. | GCTCTTTTTAAGCATGACATCAAT[A,G]CTCACTATCATACAGAGTCATTTCC | 1,865,820 | 87 |
| 4655. | ATGCCAACAAGATATATTGCCATG[T,G]AAAGGAAAATATGAATGTAAGGGGC | 1,869,037 | 87 |
| 4656. | AAAGGTATTCAAACATTTAAGGTA[C,T]cGTTATAAGAAAAGTTCATATCATA | 1,869,270 | 87 |
| 4657. | CTATCATCAGAAAACTGATTAATG[A,C]TATGCACCAAAAGGCTACCAAAAAG | 1,869,930 | 87 |
| 4658. | CAGATAAATGCTTAAAAAGCAAAA[A,T]TACTAATTCTGGTACTCACGAATCA | 1,870,000 | 87 |
| 4659. | GGATAAGCATTCTGAATCAGAGCT[A,T]CCAGAAGCGGGTCCAGGTATGGCGA | 1,870,963 | 87 |
| 4660. | ATGTAGAAATATTAAAAAGCTGGC[G,A]TTGGCAAATACACAGTGTGCTACAT | 1,871,040 | 87 |
| 4661. | CAACATGTGATTTGAAGCTTGGTA[T,C]GTTGTAACGGTTTGTTCATTTGCAT | 1,871,278 | 87 |
| 4662. | CATTCTCCATACAATAGCATCAAC[T,C]GTTGTAACGGTTTGTTCATTTGCAT | 1,871,599 | 87 |
| 4663. | ATAATGCATGAAGGCAGCATGTGA[T,A]TAAACTATCACCACAATCATAGCAT | 1,871,833 | 87 |
| 4664. | AATGCTCTGGTACTATATAAAAAG[T,G]GTCTGAATTTACTAAGATGAAGTGA | 1,872,511 | 87 |
| 4665. | CGATCCTTGATGCGTCAAGAATAG[T,G]CCGCTCAATAGAGCATGGATTCATA | 1,872,605 | 87 |
| 4666. | ATACCAAGGCACGATCCTTGATGC[G,A]TCAAGAATAGTCCGCTCAATAGAGC | 1,872,616 | 87 |
| 4667. | CGGGAGTTCCAACGAGCATATGCC[T,C]GTCACTGGTATGTGGTCCTATGATC | 1,872,871 | 87 |
| 4668. | CTCCAAAGCTATACCCGGGAGTTC[T,T]AACGAGCATATGCCTGTCACTGGTA | 1,872,886 | 87 |
| 4669. | AAGGTAACAAAGATCTTTGAGCAC[T,C]AGTAGAAGAGTATTTTACAGCTTAG | 1,873,097 | 87 |
| 4670. | ACCATGATATCAAAGGCAACGATG[G,T]GGAGAGAAGGTAACAAAGATCTTTG | 1,873,128 | 87 |
| 4671. | TTTAGTTTACATGTTTGGAAGAGG[T,A]AGTCAAAAGTCAAGACCATGATATC | 1,873,167 | 87 |
| 4672. | TAAAAATTTTTGAAAATTGTTACA[G,T]ATTACTCCCTTTTTCTTCGTTCAAT | 1,874,274 | 87 |
| 4673. | TTTCCGGACTTTGGGCAGAGACTT[C,T]CCATATTATTTTGACTTCCCAAATC | 1,874,372 | 87 |
| 4674. | GTATGCAATCAAAATGGTTAGCTG[G,A]TTGGTTTCCGGACTTTGGGCAGAGA | 1,874,401 | 87 |
| 4675. | AAGGTTTTGTTTTTGGGCTGCAGC[T,A]ACTTTTCCAATTTATTGATGGCGTT | 1,881,662 | 87 |
| 4676. | TGAAAGGTTTTGTTTTTGGGCTGC[A,G]GCTACTTTTCCAATTTATTGATGGC | 1,881,665 | 87 |
| 4677. | TCTTGTGCCTAATATTTTTACTTC[G,A]ATATACACTAACTTCTATAACCCAA | 1,882,276 | 87 |
| 4678. | ATTCCTTTTTtCTTGCTGTTTTGC[A,G]TGGGCATGGAGTAAACTGTGTGAAT | 1,882,706 | 87 |
| 4679. | TCTTATTCTTCTGTTAGTTTTGAT[G,T]GACAGCAGACCTTACCTGTTTGAAA | 1,882,802 | 87 |
| 4680. | AAACATGTTTGTCCCACTCAGATT[T,G]TTTATATAATAGAGACCACTTTTCT | 1,884,074 | 87 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 4681. | GCAAATTTAATTTTATTATGCACT[T,G]ATCTGACCAAATCAATGGTTAATTA | 1,884,440 | 87 |
| 4682. | AGTAATTAATTGAGAATAGGAAGA[C,T]GAGCGTTAAAATCTTGAAGGCGAGC | 1,884,765 | 87 |
| 4683. | ACTTTCTTTAACTTCTCAATTTTC[C,T]ATATGTTTAGAATTTATATTTTGTT | 1,884,831 | 87 |
| 4684. | GCACCTTGTTATGTGAGTAATCAC[A,C]TTTCCTTCCCTCCTTTCTTGCTtTT | 1,885,151 | 87 |
| 4685. | TAACTCTGCCTCCTAGTCGGCACC[T,C]TGTTATGTGAGTAATCACATTTCCT | 1,885,170 | 87 |
| 4686. | AGCCCTTAACTCTGCCTCCTAGTC[G,A]GCACCTTGTTATGTGAGTAATCACA | 1,885,176 | 87 |
| 4687. | TCATACAAACTAATGACCTCAAGG[T,C]TAAGTCCTCTAAACCCAACAGCTTG | 1,885,267 | 87 |
| 4688. | CATTCGACCCGGTAAATTATAGAC[A,G]TATGATAGATAGTGAAATGTCTCAA | 1,885,320 | 87 |
| 4689. | TGGTCATCCTTATAGAATGATGTC[T,C]AGCATCCTTCGAAAATAATTTGCAT | 1,886,343 | 87 |
| 4690. | CTATCTATTTGAGTCAAACATCCA[A,G]CTTTGTGTACAGATTAAGACCTGAA | 1,886,662 | 87 |
| 4691. | GATCTTGACACAACACTCAAATTC[A,T]TATAGATCATACGCAACCTCTTTCA | 1,886,755 | 87 |
| 4692. | ACCTGACCCTATATTAATTGGCAC[G,A]AGGCTTGATGAATATGATTATGGCT | 1,887,158 | 87 |
| 4693. | ATAAGCTTGACTTAACATCAGGGG[C,A]AGCAGCCCTCAATATTAATCTTGTG | 1,887,222 | 87 |
| 4694. | AGGCAAGTTTTTGCTCAAGAATGT[A,G]GGAAGAGGAGGTGAAGGCCTTTGGT | 1,887,304 | 87 |
| 4695. | ATTCTAGAGGAATCACAGGAGCTG[C,T]ATAAATTAAGGCTAAAGTGATGGAA | 1,887,412 | 87 |
| 4696. | AATGAGCTATTCTAGAGGAATCAC[A,G]GGAGCTGCATAAATTAAGGCTAAAG | 1,887,420 | 87 |
| 4697. | TTTATAGAATGGCCACAGGGCTTC[T,C]AATGTTGTATGGTTTAGAAAGATGG | 1,887,564 | 87 |
| 4698. | TCATGTGATTGATGTATGCCTTGG[C,T]TACTTAGCTGAAGATTTTATAGAAT | 1,887,604 | 87 |
| 4699. | TAGGTATAGTTGAATTATGAGAAT[C,T]TTGTGAAATTTGTTTTTATGTGCAA | 1,887,802 | 87 |
| 4700. | CAGCTAAATGGTGCTAACTATTAT[C,T]GAGCCTTCTGAAGAATATCAGTAGT | 1,887,887 | 87 |
| 4701. | TTTTATTGTACAAAGCAACTTATG[C,T]AGGTTCTTTATGATCAGACCATTCT | 1,888,079 | 87 |
| 4702. | AGCATCTATGAAAGCAAGGCAAAG[C,T]GTAAGAAAATGGAGACTGAAGGAGA | 1,888,317 | 87 |
| 4703. | TTTTTGAGAAAAAGAAAGCACATG[A,G]CTCCTCATTCTAATCAAAATTTCGG | 1,890,054 | 87 |
| 4704. | AAAACCATCACCTGAAATCCAGAA[T,G]TGCATATCTATATAAATGAGCTTCT | 1,890,417 | 87 |
| 4705. | GGAGACTCATTAGCATTTTAAGTT[A,C]GATGGGAGAAATGAAACGGAAAAAG | 1,890,595 | 87 |
| 4706. | AAAAaCAAAaTGATGCAAATCCTC[T,C]AGAAATCACCAACTCTACCTACAAT | 1,890,664 | 87 |
| 4707. | AAATAAAATAGCTCCCAACATCCC[A,T]ACTTAAAGAAAAACAGAAAAATTTT | 1,890,931 | 87 |
| 4708. | GTGCGGGATTTGGTGCCGGTATTT[T,A]AAACCTCAGTAGGAATTTCATAAAA | 1,891,074 | 87 |
| 4709. | GATGGAAAGATAGTGCGGGATTTG[G,A]TGCCGGTATTTTAAACCTCAGTAGG | 1,891,086 | 87 |
| 4710. | TGATGGAAAGATAGTGCGGGATTT[G,A]GTGCCGGTATTTTAAACCTCAGTAG | 1,891,087 | 87 |
| 4711. | AGCATGTACCATCGATACTTGTAC[C,T]GCAGTGATACGTACCATTTTGATGG | 1,891,131 | 87 |
| 4712. | CTTTGCACATGATATACCATCTCA[A,G]CCAATTCTCCATCCCTTTAACCTCA | 1,891,623 | 87 |
| 4713. | TTTTtCAATAATTGCTATCAAGAT[A,T]TACCTTTGGTATTTCTTCAAAATTT | 1,891,784 | 87 |
| 4714. | CCAATTATTGCAAATATAATCATA[T,A]GTATTCTATCAAAATTATAACCATA | 1,891,881 | 87 |
| 4715. | AAGCAAGGTTCATTCTTCATCCTA[A,G]AAAAAaGCAGGAGGGAACAAAGTAC | 1,891,978 | 87 |
| 4716. | GAACAGCAAGGCAGAGGGGTAGAC[A,C]TGATTGGGCATATATTATAACTAGG | 1,892,262 | 87 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 4717. | TAGCCACTTCTAAGGAAATTCACA[T,C]CCAAAAATAAGCCAAATCAAACAAC | 1,892,699 | 87 |
| 4718. | TAAGCAGACCAAATGGATTCTTCA[G,C]TCATCTAAAAAGGACCAGGAAAATA | 1,893,241 | 87 |
| 4719. | GCCTGGGCTAACAAGCTAGAAACT[A,G]AATGAAAAGAATCTATATATTTGG | 1,893,423 | 87 |
| 4720. | ATATATATATATTTCTTGATAAGA[A,T]GAAGGGCAGACCCTCTACAATCTGG | 1,893,494 | 87 |
| 4721. | TATTTTCAATTACAGCAAAAGGAA[G,C]AGAGACAGGAGAGCAACAATTATAA | 1,894,862 | 87 |
| 4722. | GCCATGGCACATCCATTTTCTGTC[A,G]TCCATGAATTTCTTTGTTATAGAAT | 1,895,129 | 87 |
| 4723. | GTGACAGGCTCACATGAATCTTAT[C,T]ATCATCACGTGACTCGACAACTATC | 1,895,567 | 87 |
| 4724. | GCTGGAAACATATTGTCTGGAAAT[G,A]AATAGGGCAACTTTGGAAAATGCAA | 1,895,659 | 87 |
| 4725. | ATAGCAAATTGGAAGTTGCCACAG[C,A]ATATCTACCAAAAATTACCTTTTAC | 1,896,410 | 87 |
| 4726. | GTTCTCGAAATTACAGACCATATT[C,T]CATATTTTGAAAGAGTTAAAATAAA | 1,900,973 | 87 |
| 4727. | CATCTCACTCATAAAATTGGCACT[G,A]AAGTATTTGCGAAATGGGGTGATGA | 1,901,084 | 87 |
| 4728. | ATTTGGTGGCCTAAAAGCCAACTT[G,A]AGTTTCTATGAGATGGACATCTCAC | 1,901,126 | 87 |
| 4729. | TTTTAGAAACTTCATACGTAATTA[A,T]AAGATTGTATATAATATGCAAACAA | 1,901,859 | 87 |
| 4730. | CTCTTTTGTCCAGGCATCTTTCTC[G,A]ACCATTACTTCAGGAACAGAAAAGT | 1,902,441 | 87 |
| 4731. | GACCAGAAGAACCAGAAGGATACC[C,T]CCAATCCTCTTTACTTTCATTCAAC | 1,902,660 | 87 |
| 4732. | CATCGCAAAATAATGGACAGGAAG[G,A]GGTTTGGTTGGTATAGGCTAGGCCG | 1,902,897 | 87 |
| 4733. | ATAGAATTCATAAGGACATTGGCC[A,G]GGTAGGATTTATGTTCGTAGCATTC | 1,903,024 | 87 |
| 4734. | TTCTAAGATTGAAAATAGTCAAAA[C,T]AACTTGATGGTCTATTTGAATAATT | 1,903,086 | 87 |
| 4735. | ATGAAGGAAGATGAATCATTCTTT[G,A]GTGCGAAAGATACACGTCTGATATG | 1,903,159 | 87 |
| 4736. | ATTACCCTGCATGTGAGATTGGGA[T,C]AAGCCATGGATGGATAAGAAAGTCT | 1,903,579 | 87 |
| 4737. | TTTCACATGCATTACCCTGCATGT[G,C]AGATTGGGATAAGCCATGGATGGAT | 1,903,608 | 87 |
| 4738. | AACTAGGCTTTCAAAGCTCCATAT[A,T]GAAGGGCAACTTGGTCCCAATGAAC | 1,903,106 | 87 |
| 4739. | ACCCATTTTTCTAATCCGACACGC[C,T]GAGGATGGGTAGTACTGGCAACATC | 1,904,669 | 87 |
| 4740. | ATAAAGAGAAGAGGACCAGCCTG[G,A]GCGCGAAACTACTAAAATGCCCCCC | 1,907,286 | 87 |
| 4741. | CCTCGCCCCGACCAACATCGACCG[T,C]TGGAGCACCGTACCCACCACCGCCA | 1,907,500 | 87 |
| 4742. | GAAGCAGATAAAAATTAAGACCAA[C,T]GTGCGTCTTGTAGTGCAGACATTCC | 1,907,844 | 87 |
| 4743. | TTTTTTGCAAATATTCACAAAAAC[A,C]GTCCATTCGAAGCAGATAAAAATTA | 1,907,877 | 87 |
| 4744. | AAATCCAAAGAAAACAGAAATTTC[A,C]CGTTGCTACACCAGATAAAAATAA | 1,907,988 | 87 |
| 4745. | AATGCAAAAAATTATGCAAATCTC[A,G]GTAAGCATTTTAAACACACTTCAAA | 1,908,413 | 87 |
| 4746. | TAATGAAACTGGAGGAGGATGAAT[G,T]GCCAAAAAaGAAAAAGCAGCTATAT | 1,908,492 | 87 |
| 4747. | AGATGATCACACCGAATGTCACTT[T,C]GGAACAAACTCTAATATACAGCTCA | 1,908,820 | 87 |
| 4748. | AAGCATGTTTTTAGTCATTGGCTC[A,C]TAAAAACTTTCACTAGTTTTCCCCG | 1,909,032 | 87 |
| 4749. | CAAAAAaGTTCCTATAAACTTTAA[C,T]GCAGCATGGCTACATCAACAGCCAA | 1,910,986 | 87 |
| 4750. | AAAACTTAAGAAATCAAAAAATTA[G,T]TATAGCAGAATCAGTTCAATAAGAA | 1,911,191 | 87 |
| 4751. | ACCTTTCTAGTGAAATGATGAATG[A,C]AGATCAGGGGAAACAAGAAAACACA | 1,911,477 | 87 |
| 4752. | AATGTTACAGTTGTAATAGTTGAA[C,G]GATACGTAAGACACCTTTCTAGTGA | 1,911,514 | 87 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 4753. | GAAaaAAAAAAaGAAAAGCATGAA[T,C]GTTACAGTTGTAATAGTTGAACGAT | 1,911,536 | 87 |
| 4754. | AAGAAATTAAGTGGGCTTAGCCAAC[A,G]AAGGCTGCAAAAACAAACTAGCATA | 1,911,610 | 87 |
| 4755. | AGGAAAAAaTGGAAAGAATTAAGT[G,A]GGCTTAGCCAACAAAGGCTGCAAAA | 1,911,623 | 87 |
| 4756. | AGAAAGGAAAAAaTGGAAAGAATT[A,C]AGTGGGCTTAGCCAACAAAGGCTGC | 1,911,627 | 87 |
| 4757. | CCAGAAAACCATTTGAACTTTTAA[T,C]TTTAAAATCACTGAAAATAAAAaTA | 1,911,731 | 87 |
| 4758. | ATGGGAGGATGCCATATGGATCTT[A,G]AAACAGTAAATCCCAGAAAACCATT | 1,911,768 | 87 |
| 4759. | CATATAAAATAATCGATAAAGTAA[T,C]GGGAGGATGCCATATGGATCTTAAA | 1,911,791 | 87 |
| 4760. | ATTGTGAACACATGATACCTACAT[G,A]TACTTTTTAGAAAGTAACAGATATT | 1,911,949 | 87 |
| 4761. | TGCTATATGGCAAATTAATTCAAC[A,T]AAAaCCATAGTTTTCAAGAATAAAA | 1,912,297 | 87 |
| 4762. | ATGCATGCAGCACGAGAGAGAGA[A,G]AGAGAGAGAGATCAAAATGCATAGG | 1,912,404 | 87 |
| 4763. | GGACATTGACATTGTCAAACATGC[A,G]CATGTATGCATGCACGCACGAGAGA | 1,912,434 | 87 |
| 4764. | TCCCCTTTTATGTGAAAAATAAGC[A,G]TATGCCTGGTAAGATGCCCTTTTTG | 1,912,870 | 87 |
| 4765. | AATGCAAAACCGAAGCGTGGGAGG[T,C]TTATAATTTTTAATCGAGTTATGGA | 1,912,968 | 87 |
| 4766. | AGCAAAAACTAAGCATTAACAATA[G,T]AATCTAAATTTTACATTTAGGTCCA | 1,913,037 | 87 |
| 4767. | CAAGCAAAAACTAAGCATTAACAA[T,G]AGAATCTAAATTTTACATTTAGGTC | 1,913,039 | 87 |
| 4768. | ATGAAAACATTAAGGATACTAAAa[C,T]AAAAAaTATATCCTGAAACCTGATA | 1,913,128 | 87 |
| 4769. | AGGATCATATATTAAACAAAATCA[A,T]GACAAACAATTTATATAGAAGGGTA | 1,913,304 | 87 |
| 4770. | ATTATAATCCAATTAGTAAGTGGG[G,A]GTCCTATTATTGGAATTCTCGTTGA | 1,926,205 | 87 |
| 4771. | TGGGAGGTGTTTTTGTGTTAAGCT[C,T]GGTCATTTTCAGTGTCGGGATTTTA | 1,926,272 | 87 |
| 4772. | TTGTGGAATTGAATGGGAGGTGTT[T,C]TTGTGTTAAGCTCGGTCATTTTCAG | 1,926,285 | 87 |
| 4773. | GTTTCATGCATTTTTTTtATAATT[C,T]GATTGTGGAATTGAATGGGAGGTGT | 1,926,312 | 87 |
| 4774. | CAACATGTACATACCCATATCAAG[A,G]CATTAAAACAAGCCAATCAATTAAT | 1,927,461 | 87 |
| 4775. | CATCCAGTTATATATTATCATCTA[C,T]GGTTGAAAATATGCATCATAAAACA | 1,927,591 | 87 |
| 4776. | ATATTACGTTGGGAGATAAGAAAA[C,A]CTGTGTACCTCTAAGATAGATAACA | 1,927,648 | 87 |
| 4777. | AACTTTATGATCTATCTCATCGTA[T,C]TTTAAAATTAGTTAAAAGTGCAACC | 1,927,808 | 87 |
| 4778. | CGTATTTTACATAATATTTAAAAG[G,A]TAATATTAACTTTATGATCTATCTC | 1,927,840 | 87 |
| 4779. | TCTTTTACAATATCAACAATTGGG[T,G]CGTATTTTACATAATATTTAAAAGG | 1,927,865 | 87 |
| 4780. | TCGTTGCTGTCGGAGTGGCTCTCA[A,G]TGCTGAAACGCTCGCGGTGGGACGA | 1,928,057 | 87 |
| 4781. | ACCATCATCATCCGCTCGCAGTCC[T,G]CCAGCTCCATTGGCGAGGGATCCAC | 1,928,142 | 87 |
| 4782. | ACGAAGAAAAGAAGGGCAAGAAGG[A,G]AGGAGACGACCTGTCAAGAGCCGAC | 1,928,245 | 87 |
| 4783. | ATCTTGACTCGAATCCCAAATCCA[C,G]CCAAAAACCCACAGAACGGAATCAA | 1,928,414 | 87 |
| 4784. | ACAGATTGATACTTATTTTGTTAC[G,C]AACATTTCTCTAATCATAACCCAGA | 1,928,554 | 87 |
| 4785. | ATATAACCACTAAAGATAAGAAAG[C,T]AACCGAGAAAGAAAACTTTCTGTAC | 1,928,624 | 87 |
| 4786. | GTATCGGAATGGAAAACGTCCTTG[C,T]AGAAAGTTTGCACCAGGCCCACGCC | 1,928,681 | 87 |
| 4787. | CACGTATAGTTGCAGCAAGTCTCA[G,A]AGTAACTATAAATTTGCAGCAAAAA | 1,928,735 | 87 |
| 4788. | GTTACCAACGCATTAATTAGAAGA[C,T]GATCTAATTTCATTCCCAAGATGCT | 1,928,810 | 87 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 4789. | TCCGACTGAGTAGCATATATTCTC[G,A]TGAACAAAGAGGGGAAAGAAGCAGA | 1,929,025 | 87 |
| 4790. | TGAATCCGACTGAGTAGCATATAT[T,C]CTCGTGAACAAAGAGGGGAAAGAAG | 1,929,029 | 87 |
| 4791. | AAATTATACACACAAATGACAGTC[T,C]TTTAGATGTTTGAATCCGACTGAGT | 1,929,064 | 87 |
| 4792. | ATAAGAAAATTATACACACAAATG[A,G]CAGTCTTTTAGATGTTTGAATCCGA | 1,929,070 | 87 |
| 4793. | CCGTACTAATAAATCATATTAGAT[T,G]CAATGAAAAGGAACATAAGTGCCCT | 1,929,407 | 87 |
| 4794. | ATCCACCAGAACTACTGGTCTTAG[T,G]CCAGTGCATAAACAAAGTATGTCTG | 1,929,562 | 87 |
| 4795. | ACCTCCTGGGCAAGGCGAAGTAGT[A,G]AGCAGAGGTCCTCTTGGAGTTTTGG | 1,929,627 | 87 |
| 4796. | CACTATCTAATACAACTTCACTAA[A,G]AAGCCTATGAGATTTCCATAAGACA | 1,929,850 | 87 |
| 4797. | AGGAAAAAATCTACATGTTTCTTT[T,C]TGTCTTCCATAAATCTACAGGAGGG | 1,929,974 | 87 |
| 4798. | ACATGATATCTACGCTTAAGGAA[A,C]AAATCTACATGTTTCTTTTTGTCTT | 1,929,993 | 87 |
| 4799. | TATAGAAGATATCCTCTTATTTCA[A,T]TGAGATTTTTTtCTTTTACTTTCC | 1,930,408 | 87 |
| 4800. | TAaAAAATAACAAATTTATAGAAG[A,T]TATCCTCTTATTTCAATGAGATTTT | 1,930,424 | 87 |
| 4801. | CCAACTCATACTCTCTCACCCTCA[G,C]CCCCCAATCTTGTTCTCTCTTCATT | 1,931,314 | 87 |
| 4802. | TAATACCTCTATCTCGTACTCTCT[C,G]ACTCTCTCTTTCCCTTGCTCTGTTT | 1,931,364 | 87 |
| 4803. | CCTATTATACCTCAGAGGTAACCA[A,G]TTAAAAGTTGCTAAGTACTCAAATC | 1,931,504 | 87 |
| 4804. | TTTTGATGCAAATATCCAGCCTGG[G,T]GGAAACCTATTATACCTCAGAGGTA | 1,931,534 | 87 |
| 4805. | CTTAAATGTTTAAGTTTCTACTGT[T,A]TCCAAAACCAATTTTGGAGTGTAGG | 1,932,053 | 87 |
| 4806. | CTTGGTTCTATCTTAGCTCTGTATA[A,T]TAAAAGACTAAATCAGAGCTTATCA | 1,932,195 | 87 |
| 4807. | TGGAACCATCACTACCCTCTCCAAT[A,G]GAGCACTTGGTCTATCTTAGCTCTG | 1,932,225 | 87 |
| 4808. | GAAAACCGGGACACCTCTGTCCCA[T,C]GAGATTTAAGACCTTAGTCTTTAGC | 1,932,306 | 87 |
| 4809. | ATTAGATCGCATGATCAGGACTGC[A,T]ATCGAGACAAGACTAGACAGTGGGG | 1,932,371 | 87 |
| 4810. | aAAAGAAaGAAAAAAaGAATTAGG[G,A]GAGAGAGATGGAGGATATCTATTAG | 1,932,416 | 87 |
| 4811. | AGAAAaGAAAAAaAAGAGAAAGGG[G,A]TAAGGAAAGAAAGAAAAAaTAAAGG | 1,932,477 | 87 |
| 4812. | GAGAAAACGGGACTGGGACAAGGT[T,C]GGGACTCCGAAACCCATCTACACAA | 1,932,642 | 87 |
| 4813. | GACAGGGGGTGTCCCGGCCGTCCC[A,G]TCCGTTCCTATGAGAAAACGGGACT | 1,932,678 | 87 |
| 4814. | GGAATAACGAAGAATAACAGCAAG[G,C]CTTCTCTAAACTAAAACAAATACCG | 1,932,794 | 87 |
| 4815. | TAACATCTACTCTATCTCATGGAT[A,T]AGTATTACCTAGTTTTTGTCACCT | 1,932,854 | 87 |
| 4816. | AAAGCACACATTTCTCTTTTTCTT[T,C]CATCTGAAATTCTAACATCTACTCT | 1,932,891 | 87 |
| 4817. | ATGGTATTTAGGCATGCATAAGAA[T,C]CATAAAATCAATAAAATTACAATGG | 1,933,066 | 87 |
| 4818. | CTTTATATGGTATTTAGGCATGCA[T,A]AAGAATCATAAAATCAATAAAATTA | 1,933,072 | 87 |
| 4819. | GGGAACTATCTTCTAGCATGGATG[T,C]TACTTAGCTTTAACAAAAAaTGTT | 1,933,207 | 87 |
| 4820. | ACCAAGGGAGGCTGGCTCAAACAA[T,A]TAGAAAAGGCAACACTCAACACAAA | 1,933,319 | 87 |
| 4821. | GGGAATCCTTAACCAAGGGAGGCT[G,C]GCTCAAACAATTAGAAAAGGCAACA | 1,933,330 | 87 |
| 4822. | TTTATAATTTTGGTTGAAGTCAGC[A,T]ACAGGAGGCCCTCTCTTCCTCTCCC | 1,933,605 | 87 |
| 4823. | GAGGGCCTCTACCCTCCTCTCGTG[C,T]GAAACAGGGATTCAATCTTATTTTG | 1,933,724 | 87 |
| 4824. | GGAGAGGGAGAGGAAGAGAGGCGC[T,C]GGAGGCCACCGAAGGACCTGAGGGC | 1,933,788 | 87 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 4825. | TGCTGGTCGGCTGATGGTATGGTT[C,T]GGTACAGATTTGTAACGTTCTGTGC | 1,933,909 | 87 |
| 4826. | AAGCAAGGACCACTAAATCGGAAC[C,T]GGTACAGATTTGTAACGTTCTGTGC | 1,933,948 | 87 |
| 4827. | ATAGAAGCCATAAAAGCAAGGACC[A,G]CTAAATCGGAACCGGAATCGGAGCT | 1,933,961 | 87 |
| 4828. | TAAGATAAGGTCTTGAAGAAATTA[G,A]ATATAAAGTTTTACTAAGTACTTAA | 1,934,020 | 87 |
| 4829. | TCATTAACAAGCTAGAAGAATTGC[A,T]TCATGAAATAAGATAAGGTCTTGAA | 1,934,053 | 87 |
| 4830. | TTAGACAACTCCATGCACTTCCCA[G,A]GGAAAAAAaTAAATAAATAAACACT | 1,934,200 | 87 |
| 4831. | TCTGCTGATAAGACGTACTATTAG[A,G]CAACTCCATGCACTTCCCAGGGAAA | 1,934,220 | 87 |
| 4832. | CTGCTGCTGTGAGGCAAGGCTTGA[C,T]GATATATGCTCAGCAAATTCTTTGA | 1,934,550 | 87 |
| 4833. | GAAGAACTAGCTGCTGCTGTGAGG[C,T]AAGGCTTGACGATATATGCTCAGCA | 1,934,560 | 87 |
| 4834. | ATGAAAATGATTTTTGGACTTGAC[G,A]AAGTTCTGATGCATTTTCGTTCTCC | 1,934,724 | 87 |
| 4835. | CAATCACTGGCTTTACCATGGGAC[C,A]AGGTACAATAGGTAGAACACCTGCG | 1,934,796 | 87 |
| 4836. | CATACATAAAAAAACTAGTAAAGG[C,T]GCCTCATTGGGAGGGGAGATTACCC | 1,934,971 | 87 |
| 4837. | TTAATTTGTTGAAAAGAATCTGTA[C,T]GTGAAAACGCACAACTGCATGTCTT | 1,935,031 | 87 |
| 4838. | CTTTAATTTGTTGAAAAGAATCTG[T,A]ACGTGAAAACGCACAACTGCATGTC | 1,935,033 | 87 |
| 4839. | ATGACACAATTCCTCCTCTGAGAG[G,A]AAAAGACAAATTACCTGTCAGATCA | 1,935,151 | 87 |
| 4840. | GTGTTGATGACACAATTCCTCCTC[T,C]GAGAGGAAAAGACAAATTACCTGTC | 1,935,157 | 87 |
| 4841. | TTTACAAAGAAAAGCAACAAAATA[T,G]GGTCCTCAAAATCCACTAATCGATG | 1,935,274 | 87 |
| 4842. | AGGCGGCCTATTTAAGAGTATGAC[G,A]GGTTTCTGGAACTTGTTTCTTCTAA | 1,935,470 | 87 |
| 4843. | GAGATGCTGAAGTTTCAGAATGTC[T,C]GCATTATTACATGAGCCATGTAAGA | 1,935,892 | 87 |
| 4844. | TAAGAACAGATTAGGAAGAGATGC[T,C]GAAGTTTCAGAATGTCTGCATTATT | 1,935,909 | 87 |
| 4845. | TCCTCCTGGAGCTTTGGGCTAAGT[G,T]TTCCCTTTCTGTATGTACATTAATA | 1,936,183 | 87 |
| 4846. | TATAAACAAGACAACGAACCTTAG[T,G]ACTTCATCCTCCTGGAGCTTTGGGC | 1,936,214 | 87 |
| 4847. | TCCGATGTCATGAACATAGGTTGT[G,T]AATCCATCATAACCAATATATTTTT | 1,936,458 | 87 |
| 4848. | CATATAGATGTCTATTGTGCGGCA[G,C]GCATAAATATTGTTATATTTATCCC | 1,936,571 | 87 |
| 4849. | ACATATAGATGTCTATTGTGCGGC[A,C]GGCATAAATATTGTTATATTTATCC | 1,936,572 | 87 |
| 4850. | TACTTCATCGATTAGGTTTAACAT[A,G]TAGATGTCTATTGTGCGGCAGGCAT | 1,936,592 | 87 |
| 4851. | TTTTTtCTTCATTTTTTCTGTTGG[C,T]TCTGATTTTCTATTGGAAGCTTAT | 1,936,977 | 87 |
| 4852. | TTTTTTTtCTTCATTTTTTCTGTT[G,A]GCTCTGATTTTCTATTGGAAGCTT | 1,936,979 | 87 |
| 4853. | AGATTTCGAGCTGCGAGACTTATT[A,G]TCTTAATCTACCAACTACTACATGT | 1,937,277 | 87 |
| 4854. | GAAAATCCCGACAGAAAAGTTTGG[A,G]TCGGGTCTCAATTGCCCGACACCGA | 1,946,522 | 87 |
| 4855. | AGCACAGTCTCCCTCATTTTCGCG[G,A]TCGTCCAAGTTCCTTCGGCCTACAA | 1,946,822 | 87 |
| 4856. | CGTGACGGTCGGTACCGAACCACG[A,G]CAAAGCACAGTCTCCCTCATTTTCG | 1,946,850 | 87 |
| 4857. | CGGCTACCGACTGATCGACTTAGT[A,G]GGGTCTCCACGCCCTTGATCGGCTT | 1,946,942 | 87 |
| 4858. | TTACTCGATCTTCTCCCGAATGCG[G,A]CTACCGACTGATCGACTTAGTAGGG | 1,946,964 | 87 |
| 4859. | CGACAAATATTTTGTTTTACTCGA[T,C]CTTCTCCCGAATGCGGCTACCGACT | 1,946,980 | 87 |
| 4860. | GTTGATAACGGAAGTTCGACAAAT[A,G]TTTTGTTTTACTCGATCTTCTCCCG | 1,946,996 | 87 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 4861. | TGTAAAACGAATTTTTGTTGATAA[C,T]GGAAGTTCGACAAATATTTTGTTTT | 1,947,012 | 87 |
| 4862. | GTGATTACCTTCTCAGAAGACGAC[A,G]TTCGGGGCATCCAGACTCCCCACGA | 1,947,101 | 87 |
| 4863. | GGACGTCTACAGGGGGGAGCCGA[C,T]GAAAAAGCCGCGCCCGGACGACGTG | 1,947,148 | 87 |
| 4864. | AGTCATCAACATGATCTCCAAGCG[A,G]CTGGGATCGGGGACGTCTACAGGGG | 1,947,183 | 87 |
| 4865. | GGCGCCGACTAACCAGCCGACGGC[G,T]GGAGTCATCAACATGATCTCCAAGC | 1,947,210 | 87 |
| 4866. | TTTCGAAAAGGTCCGCCGACCCGA[T,C]CGGCTGCCGATCGATGCCCCCAGCC | 1,947,269 | 87 |
| 4867. | CGAGCGATGCATCCAGTTGAAGGA[C,T]GAGATCGAAAATCTCATCCGCCGGG | 1,947,333 | 87 |
| 4868. | GAAGAATACCTGCGACGGCCTCCG[T,C]CTCTGAAGGCAAAGGGCCTCGACCA | 1,947,425 | 87 |
| 4869. | TCACCCCGCCGACAAACTCCGAGG[C,T]CGGTGCGTCCCAGGTATGACTCCTA | 1,947,524 | 87 |
| 4870. | GATCCAAAAATCACCCCGCCGACA[A,G]ACTCCGAGGCCGGTGCGTCCCAGGT | 1,947,534 | 87 |
| 4871. | ACCCCGACAGATCCAAAAATCACC[C,T]CGCCGACAAACTCCGAGGCCGGTGC | 1,947,543 | 87 |
| 4872. | GGAGCCCGCCGAACCAAGCAGGCC[T,C]CCGGCCAATAGTCGGCTTTCTCCAC | 1,947,591 | 87 |
| 4873. | AAGCATTGATGCGAAATCAATTAGC[C,T]TGACCACGATCCAAGTTTGGTAGGA | 1,949,701 | 87 |
| 4874. | ATACAATAAATAGAGAGATTGATG[A,T]GGAAAAGAGTGTATTGGAAAATGGA | 1,950,032 | 87 |
| 4875. | ACACAAATTTGTAGGTATGACATA[C,T]AATAAATAGAGAGATTGATGAGGAA | 1,950,053 | 87 |
| 4876. | TTCCATCAAATCATGCCATTACTA[A,G]GAACTGGTCATTAAATCAGATAAAA | 1,951,384 | 87 |
| 4877. | ACTTTAATTGTTGTTTTCAAAAAT[A,G]TTGACGAAAAATTCTAATACAATTC | 1,951,431 | 87 |
| 4878. | ATACGTGGTAAGTCATTGGGCCAT[A,G]TTTTTTCGACCTCTCCCTTCCAACC | 1,951,484 | 87 |
| 4879. | CATGATCCAACAATCCATATTTTG[G,A]CTGCTGACTTCTCTATCAATGGCCG | 1,951,802 | 87 |
| 4880. | ATCATTAATCCTCGTATCAGCCGC[C,T]GACCTAAACATAATTTTTTGACTTC | 1,951,870 | 87 |
| 4881. | AAATCAAAAGTATATTAATTTTG[G,A]CAATACTATTCAATAGACATGCCAT | 1,952,373 | 87 |
| 4882. | AAaTTTtTTtATTTGAGCTTGAGT[T,C]CTACTGTGCACCGTAAAATATGA | 1,952,563 | 87 |
| 4883. | ATCCCTTTTTAGCTGGTTACCAAA[A,C]AAAaTCCCTCTTTAGCTCCATTGAA | 1,952,720 | 87 |
| 4884. | GAGCCTCCTGCTCCTTCTCTCTCA[G,A]CGAGTAGTCTCTCTCTCTTCTCGAG | 1,956,642 | 87 |
| 4885. | GATCTCTCCCTCAACTCTTATACA[T,C]CCAATTTTTCTCTCCTGAAGTTCTC | 1,956,759 | 87 |
| 4886. | GAGGAGATCTCTCCCTCAACTCTT[A,G]TACATCCAATTTTTCTCTCCTGAAG | 1,956,764 | 87 |
| 4887. | GGGTGAAAAAATTTCTTACAGGGT[C,T]CTTTCAGAGCCAACATCCAAGCTTG | 1,958,168 | 87 |
| 4888. | GTAGATCCAAAAATATTGCGCTTG[G,A]CCACAAATAGAATTGTAGATTCAAA | 1,958,726 | 87 |
| 4889. | ATAAATCCAAGGAAATCAACTTGT[A,G]TAGTATCAGATCTTATGCTTGGCAA | 1,959,185 | 87 |
| 4890. | GGATATGACGGTCAAATTCAAATA[T,G]ATAAATCCAAGGAAATCAACTTGTA | 1,959,210 | 87 |
| 4891. | CTTAGAGGAGTTTGTGGGATATGA[C,T]GGTCAAATTCAAATATATAAATCCA | 1,959,226 | 87 |
| 4892. | ATTTGTCAGAAACTCGTAGTATAA[A,G]AAGGATTATTCACTTCCCATGAAAT | 1,959,324 | 87 |
| 4893. | AGTCCAATGCTTCATAATGCATCAG[C,G]AAAAATCAATCCAATAGTGTATACT | 1,959,418 | 87 |
| 4894. | AATATCCCAGCAATTTCGTAACTT[T,C]TTTtATTTTCCAAAATTTGCCATGT | 1,959,493 | 87 |
| 4895. | ATGTGAATACATCTTATGCATACA[C,T]ATACAATATCCCAGCAATTTCGTAA | 1,959,522 | 87 |
| 4896. | GTTCATAATGTTGAGTTACTTTAT[G,A]AAGTATGGAATGTAGTCTATGCATT | 1,959,608 | 87 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 4897. | CAAAACATATAGGATGCGAATGCT[C,G]GCGATAGACATAGCCAGAATATGTG | 1,960,192 | 87 |
| 4898. | CTTCGACTGCACATAATCCATACA[A,T]TGTCATTAGCTACATTAAAATGTAG | 1,960,492 | 87 |
| 4899. | GAGATTTCACAGTTAGAAGACTTC[G,T]AGTGCACATAATCCATACAATGTCA | 1,960,512 | 87 |
| 4900. | ATGACAGGCAATTAAATGACAGTTC[A,G]GAATAAGACACTTGATTATAAAGAA | 1,961,140 | 87 |
| 4901. | TAAAGTAGAATCCATAAGATCCTGC[A,G]AGACATACCATGAAAAATCATATAC | 1,961,190 | 87 |
| 4902. | TTTACCAATAGCTTTTATACGCTC[T,C]ACGCTCTTGTACCTTAAAGTAGATC | 1,961,229 | 87 |
| 4903. | CCATCTACTCTTCAAGGATACAGC[A,G]TGATAATTAAGACGATVAAGTAAGAT | 1,962,031 | 87 |
| 4904. | AATATATAAATGTGAAATTGAGGT[C,A]ATTGTATAAGAAAGAGGGGCCACAT | 1,962,244 | 87 |
| 4905. | TGCAAGTACAATAATGTAATCTAA[C,T]AGAATCTAACAATGGACCATGGTAA | 1,962,292 | 87 |
| 4906. | TATTAAAAATGATAAACAGACTCCF[T,C]AAAAAAATGATTTGTCCTAGGAAAA | 1,962,734 | 87 |
| 4907. | AACAACTCTAGCTAAAATATGCCT[T,A]TATTATATGTCCAAACCCTATAACA | 1,963,564 | 87 |
| 4908. | AATATTCACCCTATTCTTCCTCAA[G,A]GTAAAGGAGAGACCGAAAATGGTAC | 1,963,678 | 87 |
| 4909. | GTAAATATTCACCCTATTCTTCCT[C,A]AAGGTAAAGGAGAGACCGAAAATGG | 1,963,681 | 87 |
| 4910. | TAATACTTTCATTGTCTTTGATTA[G,A]TTGTTCATTGACGACTTATATCAAT | 1,964,785 | 87 |
| 4911. | AATTGGTAGAAGGATTTAAAGAGT[T,A]ATCGGCATATGATTTTCATTGGCCT | 1,965,924 | 87 |
| 4912. | ATTATATTAGTATATTAACAATGA[A,G]AAAGCATCCGAATATATGGAGTGTT | 1,966,369 | 87 |
| 4913. | AAACCGCAAGGACGATGGCTGTTC[G,A]ACAAATGAGGGGTTCCAAAGGGTGC | 1,967,159 | 87 |
| 4914. | TGGTATATTGGAATTATTTGCATC[A,G]GTGATCTCATCAAGTTGGTTGGCAG | 1,967,224 | 87 |
| 4915. | GCAAATCCAAAATAAAACCCGTCAA[C,A]AACGGCATCATCGTGACAACAACTA | 1,967,877 | 87 |
| 4916. | AAAGGTAGCGGTCCTTCTTCTCGA[C,T]TCATAGGAGTTTGGATCGGGGCTTG | 1,969,458 | 87 |
| 4917. | GAGCAGAAGGGGGTCTTGGTCCAG[G,C]CCAGTTTTGAGGATTGCGGCATGGA | 1,969,572 | 87 |
| 4918. | GCAGCGACCGCATCTCTCTCAGGC[G,A]TTTCACCAAAAACCCATCCGGCATC | 1,969,967 | 87 |
| 4919. | AGCTCCAATGCACCCAACTGAGAG[C,A]AAGCCGATAGAACACAAACGACAGT | 1,970,210 | 87 |
| 4920. | CAAAATTCCAGCCACCTTCTCTCC[T,A]AGGGTCAAGTTTCCAATGGATCTTAC | 1,970,742 | 87 |
| 4921. | TTTTCCCCTAGCACTCACTGCCTT[T,C]TCCCATTTCCCGAATGAGGCATAAA | 1,970,841 | 87 |
| 4922. | TTTTTCCCCTAGCACTCACTGCCT[T,C]TTCCCATTTCCCGAATGAGGCATAA | 1,970,842 | 87 |
| 4923. | TCTGAGGTTCTTCACAACTCGTAT[T,C]GTCGTTCCTGGTTTAGTTGAGATAA | 1,971,147 | 87 |
| 4924. | TTACAGTTCCACAGGTTTTGCATA[T,C]CTGATCAATCCACTCAATCTTTCGC | 1,971,462 | 87 |
| 4925. | TGAAATTCAATTACAGTTCCACAG[G,A]TTTTGCATATCTGATCAATCCACTC | 1,971,472 | 87 |
| 4926. | ATGAACAACATTGTTATCACATAC[A,G]GTAAGGTTCTTGAATGAAATTCAAT | 1,971,511 | 87 |
| 4927. | AAGCAATTGATGAGAAAAGTATTT[C,T]ATGACCCATATAACAGCAAATGGAA | 1,971,582 | 87 |
| 4928. | CATGCGTGGTGCAAGCAATTGATG[A,G]GAAAAGTATTTCATGACCCATATAA | 1,971,594 | 87 |
| 4929. | TCAGTTAAGTTGGATGTTTGAAAC[G,T]GTAACTCATACTTCATATGCATGCG | 1,971,638 | 87 |
| 4930. | ACGTTCACTGTATTCCTAACACCT[A,C]TAAGATCCTAGGCATCCAATAGGTG | 1,971,868 | 87 |
| 4931. | CACACGTTCACTGTATTCCTAACA[C,G]CTATAAGATCCTAGGCATCCAATAG | 1,971,871 | 87 |
| 4932. | ATTTTTAGGTACAAGATTGGTCAT[C,T]TGGTATTTAGTATTTGGGTCTTATA | 1,972,878 | 87 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 4933. | AGCTCGTTTTTAGTGCTTTGAGT[G,C]ATTGAGTGCTTCAATAAATATCACA | 1,972,957 | 87 |
| 4934. | CTTAACTTCTGAATAATGAATACT[A,G]AAAGAGTTCAGAAGTAACAAGATTT | 1,973,591 | 87 |
| 4935. | GCAGATTCATGGAATGAGAATGCAA[A,G]AGTCTTAACTTCTGAATAATGAATA | 1,973,619 | 87 |
| 4936. | GATCTCATCTTTAGGTAGAAAGGA[T,C]GGAAAAGAGGACCATAAAAACCTGG | 1,973,704 | 87 |
| 4937. | TGGATTGACTAGGGGTGACAGAAA[T,G]CAGCAAAGCTGAGGTGACTGTGTGA | 1,973,752 | 87 |
| 4938. | ATAAGCTTTTCATCAATATGCAGT[G,A]GGGCCTATTTTTGAATTGATCTTAT | 1,974,047 | 87 |
| 4939. | GGTCCATAGCGAAGTTGCTGGATT[C,T]GATAAATATAAATTAAGATTTATGC | 1,974,219 | 87 |
| 4940. | GGTCTGAGCTGGGGAGGAATGTCC[A,G]GTACTCTGCCTGCAATGACTTTTTG | 1,974,628 | 87 |
| 4941. | ATATTTTTtCCTATCCGTGATTA[T,G]TTTGGTAGGGATTGCTGAAATGAAA | 1,975,364 | 87 |
| 4942. | CTACAGCACCACGTAAGTCCAAAT[C,T]CAACTAACCCATTACATGAGTTTTG | 1,984,239 | 87 |
| 4943. | CACATTTTCAGAACACCTTAGAAA[T,A]AAATTCTGAAAAAaTGTCACTACCC | 1,984,693 | 87 |
| 4944. | CATTGGATTGTGAATGAGAAAGCT[T,C]TGAACCCAACAGTAGGCTTGAGACT | 1,985,210 | 87 |
| 4945. | AGCTTTGAACCCAACAGTAGGCTT[G,A]AGACTAGAGAATTTTCACTACCAGA | 1,985,230 | 87 |
| 4946. | CATTGGACGTCCTCAGTTGTGGAC[A,C]ACTGCTAATCATGGAATTCAGCTTT | 1,985,323 | 87 |
| 4947. | GACGTCCTCAGTTGTGGACAACTG[C,A]TAATCATGGAATTCAGCTTTATATA | 1,985,328 | 87 |
| 4948. | CTAATGTCCTCGTGTTGGTTACCC[T,C]CTTTGTTTTTCTCGTTTGTTTAGGC | 1,985,494 | 87 |
| 4949. | ATTTTATGTCTAGGAGCTTTAGTA[G,A]GTTGTAGCATTTTGTTTGATAAGCT | 1,985,544 | 87 |
| 4950. | CCTTCCTCCTGGCAAATGTAGTTG[A,G]GCCTGATTTTGGCATCCTAATGTGA | 1,986,564 | 87 |
| 4951. | TATTCTGCTTCTTTCATGCTGAAG[C,T]GTATAGGAGGCCTTTCCTTGCTTCC | 1,986,660 | 87 |
| 4952. | ATTCCAAAATGGTTGGACTGGAAT[G,A]ATTAAATTCTATCTTGATTGCATAC | 1,986,789 | 87 |
| 4953. | ATCTGCCCAATTAAAATGAGAAAA[C,A]AATATAAAATAATGACAAATTAAAT | 1,987,169 | 87 |
| 4954. | GATGAATAAAAATATAGACCAATG[A,G]aTTGCAAAAAGGTTCAACCGGAAAT | 1,987,381 | 87 |
| 4955. | GCTTGAAAGTAAAAATAAAATATA[A,G]ATCAAAGAAACCATTTTAAGTAGAA | 1,987,666 | 87 |
| 4956. | CTATGGATCATAATAACCCAAGTA[T,C]TAATTTGTCCATATATGTATCGAAA | 1,987,816 | 87 |
| 4957. | ATAACCCAAGTATTAATTTGTCCA[T,C]ATATGTATCGAAAAATAGGTTTCGC | 1,987,828 | 87 |
| 4958. | ATATATGTATCGAAAAATAGGTTT[C,T]GCATCTAGACTCGATAATGATCCTA | 1,987,851 | 87 |
| 4959. | TATATGTATCGAAAAATAGGTTTC[G,A]CATCTAGACTCGATAATGATCCTAA | 1,987,852 | 87 |
| 4960. | ATAGGCTGTCTTGCAATGATTTTT[T,C]TGAAAAACAATTAACTATTGGATCA | 1,988,086 | 87 |
| 4961. | ATTAACTATTGGATCAGCCTTAAA[A,T]TTAAACTTGAATAAGTCGAACTGTC | 1,988,120 | 87 |
| 4962. | GAATCAATAGTAATCACATGGATT[G,A]TAGTGAACGGTACAGAGCCAATAAA | 1,988,357 | 87 |
| 4963. | CAGAGCCAATAAACTGGGCACTTAG[T,G]TATGAGAAACAATTACGTGGATTAC | 1,988,394 | 87 |
| 4964. | TCTAACCATTTAATGTGATCGAGT[A,G]TGGCAAATCATTGGCACCCGCGAATT | 1,988,500 | 87 |
| 4965. | ATGTGTGCAAAAAATTCATTTCCA[T,A]CACTCTTCTTGATTGAAACTCCTCT | 1,988,707 | 87 |
| 4966. | GTGGTCAAATCTTTATCTATCTGC[A,C]TCCCACTGAACTTAGGATGGGACCT | 1,988,825 | 87 |
| 4967. | ACCTTTGTATTTTGCAAGCATGAG[T,C]GAACCTGACATAAACGTCTTGGTTG | 1,988,871 | 87 |
| 4968. | GGCCTCCCACTGACATGAATAGCC[A,G]AGTAATGAAAAGACTAATGCAACC | 1,989,404 | 87 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 4969. | CTTCTATAGTGGCAGACCGGCAGG[T,G]TATCTGACGTTCTTGCATTAATGAT | 1,989,498 | 87 |
| 4970. | TGCCACCTTGTGTTTTCGTTTCAT[T,C]GGAGTTGATTCAGATTTTCTTTTGT | 1,992,003 | 87 |
| 4971. | AAATCATCTCATTGATATTGTGAA[A,C]TGAAGATCTCAAGTTTAAGAATCAa | 1,992,174 | 87 |
| 4972. | TGAAGATCTCAAGTTTAAGAATCA[A,G]AAAAGGAGAAAAAAAaGCTTTCTAA | 1,992,199 | 87 |
| 4973. | CCATTCCACCAGATAGGTATGAAG[A,G]GAAAGTTTCATTATGCTTTCCACTC | 1,992,375 | 87 |
| 4974. | CAGTTTTTTGGGATTGTGTGCTCC[A,G]TACCTGGCCATATAAAGTATGAACA | 1,993,969 | 87 |
| 4975. | TCATATTATTTTCTGTTTTATATC[T,C]TTCTAATATTTCATTCCCATTTTGC | 1,995,369 | 87 |
| 4976. | TCTTTCCTTAAATAACTGACTGAG[A,G]CTCCCATTCTTTTGCTGGGTCTCTC | 1,995,423 | 87 |
| 4977. | ACTTATATTTTTACTGACTAATTG[T,C]TAATCAAAATGCTGCTGATTAATTG | 1,995,831 | 87 |
| 4978. | TGGAGCTGTTGGAGATGGAGTGAC[G,A]CTTAACACTAAAGCATTTCAAAATG | 1,996,198 | 87 |
| 4979. | AGGGTAAAGAAGCATTTCATCGTT[T,G]TCAAGGTTGACATCTGATCTGCAAAT | 1,997,344 | 87 |
| 4980. | GAGGAGAGGCTTTACTGGAACTTT[G,A]TCATGAACATTGTTCTATATCACAA | 1,997,657 | 87 |
| 4981. | TTTgTCATGAACATTGTTCTATAT[C,T]ACAATTTGATCCAATCAGTGGATT | 1,997,678 | 87 |
| 4982. | CAAAGATGCTATTCTTAGCTTTGT[G,C]ATATGTTTTCTTATAAAAaTATAGC | 1,997,765 | 87 |
| 4983. | AGCTTTGTGATATGTTTTCTTATA[A,T]AAaTATAGCAGAGAGTCTTTTTAAA | 1,997,781 | 87 |
| 4984. | tCCTACCTTTTTTtACTGTCCATT[T,G]ACAAAGCCAGAAGTTTTTCTTCGC | 1,997,875 | 87 |
| 4985. | CAGGTTTGTTGATTTTAGCCAGAC[G,T]AAACTTGGAGGTACTCTAGCCATTG | 1,998,050 | 87 |
| 4986. | ATTTTATTGTTAATAAGGCAGGGC[G,A]TGCAAGTATTGCTCATTGTGCCTTT | 1,999,056 | 87 |
| 4987. | TCCAGAATCTTCTTGCAAATCGAA[G,C]gTTATATTCCAAATGGGTGTGTGAG | 1,999,122 | 87 |
| 4988. | ATATGTATATGCATGGCAAATAGC[A,G]TTTTCATAATTATTCTGGAAGTAAG | 1,999,527 | 87 |
| 4989. | TTTGTAATAGATTAAAGATTTTTC[A,T]GTCTCATCTAATGCTCTAGTAGTGT | 1,999,641 | 87 |
| 4990. | AGAAATATTTTCTATTTTGACGT[C,G]GTTCAAGTTCTGTTTATTGAGAAAG | 1,999,801 | 87 |
| 4991. | GGTGGGTGGTGTTTGGGGAGTTGC[A,C]AATGTAGTGTTAGCAATACCTCCCA | 1,999,872 | 87 |
| 4992. | TCATTATTATGAAGAGTTAGGCCT[G,T]gTGCTTGCAGTGATGACACCAGATC | 2,000,065 | 87 |
| 4993. | AACTTCTCTAACAATGAGTGAGTT[G,A]AACTCTTCCAACATGGAGTTTACTC | 2,001,265 | 87 |
| 4994. | TAGATAATGTTTAAAGGTAGAAAT[G,A]TGTAATTTAGTTAAACTTATATGTA | 2,001,505 | 87 |
| 4995. | AATCCAATTCTCATATTCGTTACC[C,A]TGCAATGCAGATGCTACATGAATTA | 2,001,602 | 87 |
| 4996. | GAGATGTATGAGGGTTCTACTTCC[A,G]AGCCATCCTAGTAATGGGAGAATTC | 2,002,024 | 87 |
| 4997. | ATCAGAGGTTGAAATGGAGTTGTC[C,T]AAGTCCTAAAGAATGTTAGATATAT | 2,002,188 | 87 |
| 4998. | AATATCTTGTATTTCAAGAGAGTA[G,A]TTCCCATTTTTtGGTTTTGCTAAT | 2,002,582 | 87 |
| 4999. | AGAGGTCTCACTTGTGACTTGTTT[C,T]GGTATTTCAAGTTTTCTTTCTCAGC | 2,002,700 | 87 |
| 5000. | ATTTTCCATGGTAAAACACTTTAG[G,A]TACCATAGATGGACCACAAAAAATT | 2,003,373 | 87 |
| 5001. | ACCACAAAAAATTGTTGATCATAT[A,G]CACATTGATTATGCCCCTAGATCT | 2,003,410 | 87 |
| 5002. | TCTAAGCAGTTGCTAATTTTCTTT[C,A]aTTTGTCAGTTTATAGAATTTAAAA | 2,003,457 | 87 |
| 5003. | CTAAGCAGTTGCTAAATTTTCTTTC[A,C]TTTGTCAGTTTATAGAATTTAAAAA | 2,003,458 | 87 |
| 5004. | GTTTATAGAATTTAAAAAAaGTTT[A,T]TGTCCATAGCCTTTTAAAATGTCT | 2,003,490 | 87 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 5005. | CATGGAAGTTGTTTTAGTTTTCCT[G,A]TCAATACTGACTTGATGTTATTTTA | 2,003,819 | 87 |
| 5006. | TTTCATGTTTACTGCTCTGATGGT[T,A]TAAGCATTAGTCCGTTTGAGATCCT | 2,008,533 | 87 |
| 5007. | AAACCAAGAGATGGATAGATTGAC[A,C]TGCAACTTTTTATAGCGTTTCCATT | 2,008,787 | 87 |
| 5008. | ATTAGATGCCCTCCGTAGAATAAT[T,G]GAAAGGTTGAGAAAATAAAAGTTTC | 2,009,507 | 87 |
| 5009. | TGATTTTGAAATTAGATGCCCTCC[G,A]TAGAATAATtGAAAGGTTGAGAAAA | 2,009,517 | 87 |
| 5010. | ATTGATTTTGAAATTAGATGCCCT[C,T]CGTAGAATAAtGAAAGGTTGAGAA | 2,009,519 | 87 |
| 5011. | GACGAAGTGTGGTTGTTAGACTAT[T,C]GTTGAAGATGGTTTCTGACTTGAAG | 2,009,634 | 87 |
| 5012. | TGCATTTAATGTTGAAATATGACT[A,G]CTTATAAAATAGTTGTTACTTCCAA | 2,009,705 | 87 |
| 5013. | TTTCTCTGTGTTTTATGAAAAAC[C,T]GTGATACATGTTAACAGATATGATA | 2,009,768 | 87 |
| 5014. | ATGTTTGAGTGAAGGTGGATTTGC[C,T]GATCATTGTTTGAGTGAAGTTTATG | 2,009,899 | 87 |
| 5015. | TTTTTCTGTCAGGTACGGAAAACA[C,A]CTGTTAATTTTTGGAGTGCTATTT | 2,010,160 | 87 |
| 5016. | GAAAGCGCTGCTGTGCCCTTATTA[T,C]CTGGATGACCAGAACCAGCTCTGAT | 2,010,274 | 87 |
| 5017. | TTAACGATTTTATTGAGTGAGTTC[G,A]TCGACATTATCATTGAAAGTCATTA | 2,010,396 | 87 |
| 5018. | AAAGGTGAAGATTTCGGGGATCTA[G,C]CGTTGGAATTTGGAAACTGCTTCCC | 2,010,468 | 87 |
| 5019. | TTGAAGAATGGATTTTTCATGTTA[T,C]GTGCTTGTCTACGGTAGGTATTAG | 2,010,563 | 87 |
| 5020. | TCTTCATCCTTTGAAGAATGGATT[T,G]TTCATGTTATGTGCTTGTCTACGGA | 2,010,573 | 87 |
| 5021. | TTACTTACTGATGTTCTAAGGGGA[G,A]GCAAAATATTCATAATTCAAGCAAC | 2,020,656 | 87 |
| 5022. | AGTAATATGTGATGCAAAAGCTCA[G,A]ACATGATATGCAACCTTGGAAATCA | 2,020,709 | 87 |
| 5023. | AAATACAAGGTTATCATAATATAA[A,C]GTAATATGTGATGCAAAAGCTCAGA | 2,020,733 | 87 |
| 5024. | ACAATTTCTAATTGAATAATGTTG[T,C]ACTTCATCTCTTACCATATGGAAAA | 2,020,780 | 87 |
| 5025. | CAATCATTTGTAATATTATAAACT[A,G]ACACTTCTTTTTGGGTCCTCTTTTC | 2,020,843 | 87 |
| 5026. | AGGCATAGGGCCCATGGCCTCACC[T,G]ATTATGAGAGACAAAAGGCTAGCGC | 2,020,911 | 87 |
| 5027. | AGATTTAATCTAGTATATAACTGG[C,T]CAAATAATATAACAGGCATAGGGCC | 2,020,949 | 87 |
| 5028. | TTAGGTAGAAATAATCTAGTACTT[A,G]TTTTGCATGTCATGTAGGGATTAGG | 2,021,000 | 87 |
| 5029. | ATTAGGTAGAAATAATCTAGTACT[T,C]ATTTTGCATGTCATGTAGGGATTAG | 2,021,001 | 87 |
| 5030. | GCTTATCTGTGGATGGATTAATGG[T,G]ACATTCAAACAACCACTTATTGCCA | 2,021,156 | 87 |
| 5031. | ACCATTTTAAGACGGTTGACAGCC[A,C]CTAATCATGGCTTATCTGTGGATGG | 2,021,190 | 87 |
| 5032. | TTCCTTTCCCTCACCATTTTAAGA[C,G,T]GGTTGACAGCCaCTAATCATGGCTT | 2,021,202 | 87 |
| 5033. | CCGGAATTAGGAGTGCTTGGAAGC[C,A]CCTCTCAATCGGTTCCATTGTTCCT | 2,021,247 | 87 |
| 5034. | GATCGAGTCTTTACCTTAGAAAAC[C,T]GGAATTAGGAGTGCTTGGAAGCCCC | 2,021,270 | 87 |
| 5035. | AAATATCGAGCTCTTTAATCCCTA[T,A]AATTTAGAGATAAGGAAAAACACCT | 2,021,324 | 87 |
| 5036. | TGGATGCCCATCTAATTTATACTT[C,T]GTATATTTCCATTTCTGGATAAAGA | 2,021,420 | 87 |
| 5037. | GATTTAGATGTTTTCCTAACTA[T,C]TTTAGTTTCATCCCTTTCTCTTGGG | 2,021,477 | 87 |
| 5038. | TATCCGTATGTTTCTTCATGTGC[T,C]CAAAGTCATCTAGTTTTTCTATTAT | 2,021,557 | 87 |
| 5039. | TTTTTAAACAATTGTATTTCTATC[C,T]GTATGTTTTCTTCATGTGCTCAAAG | 2,021,577 | 87 |
| 5040. | TAGATAATCGCTTTCATTTCACGA[T,C]GTATCATGCCATTTGTATCGGTTA | 2,021,743 | 87 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 5041. | TGTAGATAATCGCTTTCATTTCAC[G,A]AtGTATCATGCCATTTTGTATCGGT | 2,021,745 | 87 |
| 5042. | TTTAAATATGTCCCTAAAGTGATT[G,C]GATTTTTTCAAAACCAATGATTGGC | 2,021,849 | 87 |
| 5043. | GAACCTGAGAGTCCAACAACTTGA[T,A]TATATATGCACATACTATATCATGT | 2,022,087 | 87 |
| 5044. | ATTCTAGGATCTGATTTCACATCA[G,T]ATTGAAGTCGAATATAGCGATATCA | 2,022,145 | 87 |
| 5045. | TGTACAAATAATACCCGAAAACCT[G,A]ACAATTCGACTCGATTATTTTGTAA | 2,022,250 | 87 |
| 5046. | TTGGACTTTGTGGCCTTCCACCCG[T,C]AGAATCGAGAAATTTGTTTATGGAT | 2,022,648 | 87 |
| 5047. | AATGAAAATGTTCACCTCTTCTAC[T,A]TTTTGTTGTTCTGAAAAAACATAGA | 2,022,724 | 87 |
| 5048. | ATGCTAAGCCCCATGAAACGAGAA[T,G]AATGAAAATGTTCACCTCTTCTACT | 2,022,749 | 87 |
| 5049. | AATTACATGCTAAGCCCCATGAAA[C,T]GAGAATAATGAAAATGTTCACCTCT | 2,022,755 | 87 |
| 5050. | CTAAAGTCTAAAACATTCTAAGAC[C,T]GCCTTTTAACTAAAATGATTATACT | 2,023,121 | 87 |
| 5051. | AAGCTTACACCTGGGTTTAAATAA[T,G]AGGCAGCATGTTTTTATACTCACAC | 2,023,373 | 87 |
| 5052. | TCTTCATTCTCTCTTTGATAAGAT[G,A]ATTATAAGCTTACACCTGGGTTTAA | 2,023,403 | 87 |
| 5053. | AATGGTTCCCTTTTGATAAACAGG[G,C]CAGGTATGTGGGTCAGGTAGTCAT | 2,024,082 | 87 |
| 5054. | GTTTTCTGCAGGGAAACTGGAGTT[G,A]AATATAATTTTATGTTGGCAGGGTC | 2,024,197 | 87 |
| 5055. | ATAAATAGCATTTATGTTGAGGGT[A,C]ATGTTTTCTGCAGGGAAACTGGAGT | 2,024,224 | 87 |
| 5056. | ATGATGGACTTATTAACGTGAATG[T,C]TGGTGTCTTTGGGAAGCAGGAAGTA | 2,028,739 | 87 |
| 5057. | CCATCCTCCACAAGGGGTGGCTGA[A,T]TGCAAGCTCTGGCTGTGCTATTAGA | 2,028,804 | 87 |
| 5058. | GGTGGCTTTTCTTCTTCCGTCTA[C,A]CCCCATCCTCCACAAGGGGTGGCTG | 2,028,831 | 87 |
| 5059. | GGAAGCTACCATTACGGATTGCTA[C,T]AGTATTTAAGATACAACATCATCCT | 2,028,908 | 87 |
| 5060. | CAAGATCTTAATGCCAcGCACcGA[A,T]TGAAAGGAAGCTACCATTACGGATT | 2,028,938 | 87 |
| 5061. | CAGCAAGATCTTAATGCCAcGCAC[C,T]GAaTGAAAGGAAGCTACCATTACGG | 2,028,941 | 87 |
| 5062. | AATGTCAGCAAGATCTTAATGCCA[C,T]GCACcGAaTGAAAGGAAGCTACCAT | 2,028,946 | 87 |
| 5063. | CATATGGTATCGACCcAACTTTTC[G,A]gCCTCCCTGTCAGTATTACTAAGAA | 2,029,198 | 87 |
| 5064. | TGAAAAGGCGTTGGTGCATTTTC[G,A]TAATGTGTATTTTTTGTAAGGCAT | 2,029,245 | 87 |
| 5065. | GAAAGATGGGGCATGAGGGGGAGT[A,G]GCTGAGAGCCTAATAAGCTTTGGAA | 2,030,025 | 87 |
| 5066. | TTGACTAGAATAATTTAATTTCCT[A,T]TAAGATCATTCTATGTTGAAACCTT | 2,031,957 | 87 |
| 5067. | TAGTATATGGTGCAAGGTCCTCAA[G,T]TACAAAAATATAGTTTGTGATTCAG | 2,032,348 | 87 |
| 5068. | ATTCCGTAGCTTTTTAACAGGGCC[G,A]ATGTTACTAAATTTTTGTTAGTTGC | 2,032,511 | 87 |
| 5069. | TATTGAATGAGCTCTCAGTTTTTT[T,G]GGCATTCTTAAATATGGAACGTATG | 2,034,835 | 87 |
| 5070. | GACAAGTATTGTAATGTTTTAGTG[C,T]GAAACTGGCACAAGTATGGGCATTG | 2,035,103 | 87 |
| 5071. | GATCTAGGGGGTGTATCAAATATC[T,G]GTACACTGAACTCACCGTCCAACCG | 2,035,275 | 87 |
| 5072. | GAGGTAGTCAAGGCCAACATCCAA[G,T]CCTGTGATTCCAATGAAAAGATTGA | 2,035,574 | 87 |
| 5073. | CTTTTGTAGTTGGAGGTAGTCAAG[G,C]CCAACATCCAAGCCTGTGATTCCAA | 2,035,586 | 87 |
| 5074. | CCTAGGTTATGATAAATTTCCTTT[C,T]CcTCTTGTTCAATCCAATCTTATCA | 2,036,345 | 87 |
| 5075. | ACTTCATGTTAACTTCTCTTTATG[T,C]GTAAAAATTTGTTTCTTCTAGTTAC | 2,036,587 | 87 |
| 5076. | CCCCcACCTCATATATATATATAT[G,A]TATGTATGTATGTATGTATGTATGT | 2,039,241 | 87 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 5077. | TTTGAGTGGAGATCTACTCGAGTG[T,A]AGCCCAATCCCCCCcACCTCATATA | 2,039,276 | 87 |
| 5078. | TGGTGAACCGAACTGGCTAGAAAT[T,C]GGGAAGTTCGATTAAGCATCAAGTG | 2,039,606 | 87 |
| 5079. | AAACCAGAATTGATAAACCACAAA[G,A]AAGCCATAAGCTTCGAAACTGAATA | 2,039,811 | 87 |
| 5080. | ATAACTTCCACAGATTTTATTGTC[G,C]TGATGAGACTGACTTGATCAGAAGA | 2,044,519 | 87 |
| 5081. | CTAATGTTGTTCCCACTTCCCACT[C,T]TCTTTGTGAAGGCAACTTTATCACC | 2,044,910 | 87 |
| 5082. | CCAGTTCTGCAGGTTTGAATTTCT[T,G]GGCAAATAAATATCTGAGAACACCT | 2,045,433 | 87 |
| 5083. | TTGCTCCTGCTGTTATCAATGCAT[T,G]CTCTCACATGCCGTTCAACATTGCA | 2,047,624 | 87 |
| 5084. | TTCTAATTATACCATTTTGTATCC[T,C]CTATTTTTTGAGTCTTCAAAAAACT | 2,048,459 | 87 |
| 5085. | TGATTCTGCTGATGATTAAGTTTG[T,C]tCTCATCGTAAGAGTCAGAATATCA | 2,048,866 | 87 |
| 5086. | TGTTGCTGTCCATTTTATCTGTGG[T,G]TCTTCACTTGCATGATTATCTGATT | 2,048,911 | 87 |
| 5087. | TATATTGTGGATCGTTTCTATTTC[T,C]AACAGTAAACATCACCGTGATCCAA | 2,049,484 | 87 |
| 5088. | ATGGTTTCTTGGGTAAAATGCAGT[C,G]TCACATTTATATTGTGGATCGTTTC | 2,049,516 | 87 |
| 5089. | CAGGTTTCTCTATATCCTTTCTAA[C,G]AACTTGGGTTTTTCTTGGTCCTCGT | 2,049,641 | 87 |
| 5090. | CGAGGTGGGCTTATAATTGTAACA[T,C]GAGTTTATCTTTGTGATTCAGGTTT | 2,049,684 | 87 |
| 5091. | GGATCATTTGTGGTTCTTTCTTT[G,A]CTAGAACTCATTCAATTTTATGAG | 2,049,737 | 87 |
| 5092. | AACCTCGATGGTTTTGGTGGAACC[A,G]TGGAAGCTTTCTCATTCTTACGGAT | 2,049,841 | 87 |
| 5093. | GATTTCATCATTTCCGAACAAAGC[C,T]GAAGATCTTTAACTGTGCATTAGGA | 2,049,967 | 87 |
| 5094. | ATTCACCTTTGGTCCCTTTGAAGT[T,G]GATATCTAATTCTCAAAATTATCTA | 2,050,384 | 87 |
| 5095. | CTCAGTTTATAGCATGATCTCCAT[T,G]CGATCACCATGTAGGGAATGAAAAG | 2,050,557 | 87 |
| 5096. | TATAAATCTCTAAAAATTTATTAt[G,A]TAAGCAACAGATCTGCTTATTCAAA | 2,050,900 | 87 |
| 5097. | TTATAAATCTCTAAAAATTTATTA[T,C]gTAAGCAACAGATCTGCTTATTCAA | 0,050,901 | 87 |
| 5098. | GCCTATTTAGTGATTCTTCTCTCC[T,C]CAAAATCTTCAATCATAACATTTAT | 2,050,947 | 87 |
| 5099. | CTTTTTTCTTGATTATTTATCTTT[T,G]TTTTTtAATTATTTAACTTCTCTT | 2,054,056 | 87 |
| 5100. | ACCTCGAGTGCCTCACTCACCTCA[A,C]TGTTGGTGCCTTTTTTGCACCTTGA | 2,055,263 | 87 |
| 5101. | CCTAATTTATGATAATCCAGCTGC[C,A]AGACACAAGTGAAGCGCACCTCGAG | 2,055,305 | 87 |
| 5102. | ACCCATAGAGTTTTGGCTGTTTTG[T,C]CGTTCTTTTCTCATCCTAATTTATG | 2,055,344 | 87 |
| 5103. | AGGGTTCCGGGAGTCCGATGGAGG[G,A]CTTTGACGATTGGGGTCTAAGCGCC | 2,055,785 | 87 |
| 5104. | TGGAATGAAAATAGGGTCGAAATT[T,C]tAAAACTCATTTACACAGCGAGAGA | 2,056,546 | 87 |
| 5105. | GGTATATTGATCTTTTGGTAATTC[C,T]TTTTATCAAAAAATTATGTCAATTG | 2,056,774 | 87 |
| 5106. | ATCCTTATAAACTAGTCGTTTATG[A,G]TCATTGGTAAAGGTATATTGATCTT | 2,056,810 | 87 |
| 5107. | GTGCTATCATAACAAGATCTATTT[A,G]TACTAATAACTAGAAGCGAAAATAG | 2,057,128 | 87 |
| 5108. | TCACCATCCAAAATTAAATTTAAT[A,G]aTTGTTTCATTAAAGAAACACCAGC | 2,057,924 | 87 |
| 5109. | AAAAAATATCTCTAAATTTTTATT[A,G]aGAATTGAATTACTTGTTATTCGAA | 2,059,926 | 87 |
| 5110. | TCAGTATTTTATTTTTAAATACTA[C,A]ATCATTACTTATTATTATAATCAAA | 2,060,707 | 87 |
| 5111. | TACCCATGAGGTGGTCAATTCATC[G,A]TGCAACCTCTTGAGATATGATCAGT | 2,060,752 | 87 |
| 5112. | TGGAACCTTGCAATTGAAGATGGC[A,G]GTACATGCAAGTGAGTTGCTTGCAA | 2,060,896 | 87 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 5113. | CATGATATAATATCTACTATAGCA[A,G]TTGTTGCTGCTAAATATTAAAAATA | 2,061,431 | 87 |
| 5114. | GAGAGCCAGAACTGAGGGAAGTGT[A,C]AGAAGAGAGGCAAAGGTAACCCAAC | 2,062,208 | 87 |
| 5115. | AATCCCTACATGCTTGGAGAGATA[C,T]GAGATAAAATCTGAACAAATTATAC | 2,062,318 | 87 |
| 5116. | AACATAAAAGAAAACATCCACAGG[G,A]ATCTTAAATCTTCGGACAAGCAATA | 2,062,625 | 87 |
| 5117. | AGAATTAAAaAATATATATATAGT[T,G]TtAACAGTGCTAAAAGCCTACCTTG | 2,063,381 | 87 |
| 5118. | AAACCATATCAAAAAGAATTAAAa[A,T]ATATATATATAGTTTtAACAGTGCT | 2,063,395 | 87 |
| 5119. | CAACAAAAGAAAGAAAAGTAGCAA[C,G]CcACATGCCACAGAAATAGGGAATT | 2,063,789 | 87 |
| 5120. | CCCATTCGTACTGTCTGCATCTCT[G,A]TTTAGCCAGAACGAGAATACCTTGT | 2,065,527 | 87 |
| 5121. | TGGAACATAGGTATGTTCTCCCTT[G,A]AAATGTCTTGGATCAACACCTCCAA | 2,065,590 | 87 |
| 5122. | TACAAGCTTGAAGGAACATACAGT[A,T]GGCCCTGCAAGCAAGGAAGTTCCAG | 2,065,954 | 87 |
| 5123. | CCTAGTTGGCATGATTATCCATCA[T,C]AGCTTTATCTTAAAGCAAGAGAAAA | 2,066,200 | 87 |
| 5124. | ACAAAGACAGCATCTTTGCAAAGA[A,C]AATACCTAGTTGGCATGATTATCCA | 2,066,229 | 87 |
| 5125. | AGGAAAAAGATATAGTGAGTTTGG[A,C]ATACTCAAACATGAAGTAAAGAGGA | 2,066,410 | 87 |
| 5126. | TGCTGAAGTGGGCCTCAGCACCAG[A,G]CCAAGTGCCAAGCAGACAGGCCCT | 2,066,502 | 87 |
| 5127. | ATAAAAATTTAAGAAAATTGAAAT[T,C]CATAACTCCGTAATTATACCACCGT | 2,067,047 | 87 |
| 5128. | TATTTGGGCGACTATGGTCTGAAA[T,C]GATTAAAAGGATCAAATATAAATTT | 2,067,345 | 87 |
| 5129. | GTATCAACTCTCCATACTGTTTAA[T,C]GACCTCTTTACATTCCATGCTCACA | 2,067,421 | 87 |
| 5130. | ATTATCTCCTTACCTCTTCTGGAG[T,A]TAGGCTGAAAGTTTTATTGGCTATT | 2,068,130 | 87 |
| 5131. | AGTGATTAAGCCTAATATATTATC[T,G]CCTTACCTCTTCTGGAGTTAGGCTG | 2,068,148 | 87 |
| 5132. | TTCATTGTGATGTAAAAAGGGCGT[C,T]TGAGCCCAAGCAGGGCTAGAGTGGG | 2,068,961 | 87 |
| 5133. | TAAGCTTCCCGGTCTTCATTGTGA[T,C]GTAAAAAGGGCGTCTGAGCCCAAGC | 2,068,975 | 87 |
| 5134. | AAGAAAATAAGTAGGTAGCAAGTC[A,G]ATTGATAGAGAGGAAGGACACTT | 2,069,390 | 87 |
| 5135. | AAAGTATTAATCCTGCAATGCGGA[C,A]GAGCTAGAAATATCTCAAAGTTTAT | 2,070,431 | 87 |
| 5136. | ACCCCGCCCAAATACCCACACGTC[C,T]ACCGGCACTTCTCCCCTACCTTATC | 2,075,030 | 87 |
| 5137. | CTTCGACACGTGTCGAGTACGTAA[C,G]CTCGAAGTCTCCTATTTCCTACGCA | 2,075,158 | 87 |
| 5138. | GACATGGTCCTGGAATATAGGCCA[G,T]GGCGCATGAATCAAGTGGCTGATGC | 2,077,325 | 87 |
| 5139. | TTTCTGGCAGAGTTTGACATGGTC[C,T]TGGAATATAGGCCAGGGCGCATGAA | 2,077,340 | 87 |
| 5140. | ACACAGAAGAAGCTATCTCCCAAA[T,C]AAGCCCGTTGGCAAGATTTTCTGGC | 2,077,382 | 87 |
| 5141. | GCTGCGGTTGCCAGATCATACACT[G,A]CCATTCGAAGTCCACACTGATGCTT | 2,077,638 | 87 |
| 5142. | CACGGTTTATTACGGGTTATTCCC[A,G]TCGTGCTGCACCCTTGACGGAGTTA | 2,077,774 | 87 |
| 5143. | AACATTTACTTTTATTCTTTTAA[T,C]GATGCTGATTTTTCCTATGATGTTA | 2,078,081 | 87 |
| 5144. | CTTCCTTGTTTGGATCATCCTTTT[T,C]GGATGTTGTGATCTCCTTCTTCATC | 2,079,748 | 87 |
| 5145. | GGGCCTCGTGCGGACAATCTCGAT[A,G]CCATCCGAAGTGGGGTATGTGCGAG | 2,080,066 | 87 |
| 5146. | ATCTTATCTTCATCTTAGCCCTTC[T,G]GGGCTTACCAATCCGGAGATCGGGT | 2,080,858 | 87 |
| 5147. | ATCGGATTTTGGTCTTCTCAGGA[A,T]TGATCCGAAGGTCGATGTTTAGGTC | 2,081,308 | 87 |
| 5148. | TTTATGAGATTTAATCCAGAGATC[G,A]GATTTTTGGTCTTCTCAGGATTGAT | 2,081,329 | 87 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 5149. | TCCAATCCGGAGATCAATTTTTCT[G,A]CATAAAATTTTAGTGAAGTCCACTC | 2,081,433 | 87 |
| 5150. | TATCTTTTCGAGACTTGCGAAGTC[C,T]AATCCGGAGATCAATTTTTCTGCAT | 2,081,455 | 87 |
| 5151. | AGGGCATTTCACATGAAATTTTAA[G,A]CTAGAATTTATCTTTTCGAGACTTG | 2,081,488 | 87 |
| 5152. | CCAAGAAAAAGTTTTCAACTTGT[C,T]CGATGTGGCAAATCTGTACCATTTG | 2,081,645 | 87 |
| 5153. | GATCGGCTTTATGATGACATCAGC[T,C]TTCCGATAAGGTCGGCTTTATGATG | 2,081,862 | 87 |
| 5154. | GGCCTTATGATGATCTCAGAGTTT[T,C]GATAAGATCGACTTTATGATAATCT | 2,082,061 | 87 |
| 5155. | ATAAATCTTTTTTATGTCATATTA[C,A]ATTTATATGAACAAATTGAACAAAC | 2,083,116 | 87 |
| 5156. | CTCATCTGGGATGTCTGGACCTCT[C,T]TTCGTCAAACTGTTGCAGTTAGAGT | 2,083,414 | 87 |
| 5157. | GTTTGGATTCAGAGAGGTGCTAGG[C,T]AGCTCGAAGCCCATCCTCTCATCTG | 2,083,456 | 87 |
| 5158. | TGATGGGAGACTTATAGTGGCTGG[T,G]GGCTCCCACCCCTTTGAGCCTTCTG | 2,083,610 | 87 |
| 5159. | AGGGACAGGAGAGGTGGAGCAGGC[T,C]TTGTTATCCATGGCCCTGATGGGAG | 2,083,651 | 87 |
| 5160. | AACTTTGATGGCTGTGTCAGGGAC[A,G]GGAGAGGTGGAGCAGGCTTTGTTAT | 2,083,669 | 87 |
| 5161. | CGTGATGATCTCAGATCAGAGGGA[C,T]ACTTATATCCATATCTTTTTGGAAT | 2,084,900 | 87 |
| 5162. | ACAACTAATACCTATCCAAAGTGG[C,G]TGACAAAAAGAATGTTAGCTTCTGA | 2,085,871 | 87 |
| 5163. | AAAATAGGCACCTTCACAAGAGCC[G,A]GTGGGTAGGTAGAGTAGGATAAGAA | 2,085,962 | 87 |
| 5164. | TCTGAAAGTCCTCGTTGGTTACTC[A,G]CAGCCGCACAAGCATCCAATCTCTA | 2,086,579 | 87 |
| 5165. | GAACAAGGAGATGGTACGTCGAGA[T,C]GATCGCCTTGAGGGCGTTCAATCCG | 2,088,651 | 87 |
| 5166. | ATCTCCGCGCATCTCTCCGATTCC[A,G]TTTTTGGTCGGGAACCGAACAAGGA | 2,088,692 | 87 |
| 5167. | GATCTCCGCGCATCTCTCCGATTC[C,T]ATTTTTGGTCGGGAACCGAACAAGG | 2,088,693 | 87 |
| 5168. | TCCCTCGACTCGTCGCTTTGAGCG[A,G]AGATTTGGAAGCATCGTCGGGCGAG | 2,088,748 | 87 |
| 5169. | TCCAGCTTGTCGATCGTCAGAGAA[T,C]CCCTCGACTCGTCGCTTTGAGCGAA | 2,088,772 | 87 |
| 5170. | CGAGCCTCGTTCTTCCTCCTCCCG[T,C]TGGTCCAGCTTGTCGATCGTCAGAG | 2,088,800 | 87 |
| 5171. | GGGATCGCCTCGAGCTACTCGGCC[A,G]GCGAGCCTCGTTCTTCCTCCTCCCG | 2,088,826 | 87 |
| 5172. | CTCCTATCGGGATCGCCTCGAGCT[A,G]CTCGGCCAGCGAGCCTCGTTCTTCC | 2,088,834 | 87 |
| 5173. | CAAATATGTCGGCATTGGCCGTCA[A,G]CAGCTCCGTCAGACGGCGTCGTTCG | 2,088,930 | 87 |
| 5174. | GATGCCCGACATATCTGCTGTCGA[T,C]CAAGCAAATATGTCGGCATTGGCCG | 2,088,959 | 87 |
| 5175. | CGGGGATGCCCGACATATCTGCTG[T,C]CGATCAAGCAAATATGTCGGCATTG | 2,088,963 | 87 |
| 5176. | TGAGTCGGTGGGTTATTATTTCTG[C,G]GGGGATGCCCGACATATCTGCTGTC | 2,088,987 | 87 |
| 5177. | GGAGCGAAGGACCTCTTCTTCTGC[T,C]TCACCGGTCTCATCGTCGGGTCGAT | 2,089,039 | 87 |
| 5178. | CTGCCTTTCTGGAGCGAAGGACCT[C,T]TTCTTCTGCTTCACCGGTCTCATCG | 2,089,049 | 87 |
| 5179. | CTTTTTTGACCATGACAACATTGG[C,G]GAGCCAATCGGGATACGTGGATTCT | 2,089,149 | 87 |
| 5180. | GAAGTGGAGGATCTGCATCGACTA[C,T]ACCGACCTCAACCGAGCCTGCCCAA | 2,089,156 | 87 |
| 5181. | CTGCATCGACTACACCGACCTCAA[C,T]CGAGCCTGCCCAAAAGATAGCTTCC | 2,089,168 | 87 |
| 5182. | GTCGATGCAGATCCTCCACTTCCC[A,G]TTGGCTTTTTTGACCATGACAACAT | 2,089,178 | 87 |
| 5183. | CATCCACCAGCTGGTCGATCTTGG[A,G]AAGCGGGAAGCTATCTTTTGGGCAG | 2,089,248 | 87 |
| 5184. | GCATCCACCAGCTGGTCGATCTTG[G,A]AAAGCGGGAAGCTATCTTTTGGGCA | 2,089,249 | 87 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 5185. | ATGAAGCTGAGCAGTCGAAATCCG[A,G]ACGTCGCATCCACCAGCTGGTCGAT | 2,089,279 | 87 |
| 5186. | AGACGAGGAGCACACCGCGTTCGT[G,A]ACTCCCAAGGGCCTCTACTGTTATC | 2,089,321 | 87 |
| 5187. | GCTCCTCGTCTTCAGGCACCATCC[A,G]GATCTGATTGTACCCGACGAAGGCG | 2,089,332 | 87 |
| 5188. | CACCGCGTTCGTGACTCCCAAGGG[C,T]CTCTACTGTTATCGGGTGATGCCCT | 2,089,333 | 87 |
| 5189. | AGGTGGCACCGGCGTTCTTCAGTC[T,C]GAAGGGCATCACCCGATAACAGTAG | 2,089,410 | 87 |
| 5190. | ATTGACAAGTCGCTGGTAGGTGGC[A,G]CCGGCGTTCTTCAGTCTGAAGGGCA | 2,089,427 | 87 |
| 5191. | CTGGTCTTTGAAGACCTTATTGAC[A,G]AGTCGCTGGTAGGTGGCACCGGCGT | 2,089,445 | 87 |
| 5192. | AATGAAGCTCAACCCGACCAAGTG[T,C]GCTTTTGGGGTGACCTCAGGGAAGT | 2,089,555 | 87 |
| 5193. | CATTCGGTGTCGTCGAAGGGTGCG[G,A]AAGGTCTCCTCGAGATCCTAAACAT | 2,089,559 | 87 |
| 5194. | CTTCCCTGAGGTCACCCCAAAAGC[A,G]CACTTGGTCGGGTTGAGCTTCATTC | 2,089,604 | 87 |
| 5195. | TGGCCTCAATCCCTCTCTGAGAGA[T,C]GAGGAATCCGAGGAACTTCCCTGAG | 2,089,644 | 87 |
| 5196. | ATTGGCCTCAATCCCTCTCTGAGA[G,A]ATGAGGAATCCGAGGAACTTCCCTG | 2,089,646 | 87 |
| 5197. | GAGGATTGCCTTTATTTTCTCAGG[A,G]TTGGCCTCAATCCCTCTCTGAGAGA | 2,089,670 | 87 |
| 5198. | TCGACTAAGAGCGACAATTCTTTC[G,A]TTCAGCTGTTGGACCTCCTTCTTGG | 2,089,739 | 87 |
| 5199. | AATCGACTAAGAGCGACAATTCTT[T,C]CGTTCAGCTGTTGGACCTCCTTCTT | 2,089,741 | 87 |
| 5200. | AGAGATGAATCGACTAAGAGCGAC[A,G]ATTCTTTCGTTCAGCTGTTGGACCT | 2,089,748 | 87 |
| 5201. | GTGGCGCAGAGTTTTGAAGAACGG[T,G]AGGCACCTTTCAGCTGATCGAGAGA | 2,089,793 | 87 |
| 5202. | CGGCGGGGAAGCCAAGTACTTTTT[T,C]AGGTCTTCGAAGGCCTGTTGGCATT | 2,089,868 | 87 |
| 5203. | TTCCCCGACCTGCGGCTTTACGAG[T,C]AGCGGCGGGGAAGCCAAGTACTTTT | 2,089,895 | 87 |
| 5204. | CTCAGGAGATGTGGCCAAGTAGAG[A,G]TACAAGGTTTCCCCGACCTGCGGCT | 2,089,928 | 87 |
| 5205. | CGAGTACCGAACTGATCGCCTCAG[G,A]AGATGTGGCCAAGTAGAGATACAAG | 2,089,947 | 87 |
| 5206. | CGAGAAAATGAGTGCCGAACCCAT[C,T]AGCCTATCTACTACACCAGCAAGGT | 2,089,949 | 87 |
| 5207. | CACTCATTTTCTCGGACGAGTACC[G,A]AACTGATCGCCTCAGGAGATGTGGC | 2,089,963 | 87 |
| 5208. | TCGGCACTCATTTTCTCGGACGAG[T,C]ACCGAACTGATCGCCTCAGGAGATG | 2,089,967 | 87 |
| 5209. | GATAGGCTGATGGGTTCGGCACTC[A,G]TTTTCTCGGACGAGTACCGAACTGA | 2,089,982 | 87 |
| 5210. | GGCGAAAATCATCTTTTCCGTCTC[T,C]GAGTACCTTGCTTCGGCCCCGTGGA | 2,090,051 | 87 |
| 5211. | CGCGCAACGACTCCGTCCATACTT[C,T]CAGGCCCACGCCATAGTGGTGCTCA | 2,090,062 | 87 |
| 5212. | TCGGCGCAGTATCGCCCTCAGGGG[T,C]TGGTTGGTGAGCACCACTATGGCGT | 2,090,144 | 87 |
| 5213. | GCTTCATCGCCCACTTCGCGAGTC[A,G]TCCAGATGTGTCGGGTCGGCGCAGT | 2,090,184 | 87 |
| 5214. | TCGGTACTGAATGTCGAACTCGCT[A,G]AGCTTCATCGCCCACTTCGCGAGTC | 2,090,210 | 87 |
| 5215. | TGACAGAGCTCATTCAATAATTTT[T,C]GAAGATCATGGATGATGAGATGTAT | 2,096,183 | 87 |
| 5216. | AAGCCGTTTCCGGATAAATCCCTG[A,G]ACGAAGAGGGAAATTTCAATGACCC | 2,096,914 | 87 |
| 5217. | CGTTAACCAGACCCGTTCGATCTC[A,G]TCTCAGTGGCTCCAATTTCGTGTTT | 2,097,200 | 84 |
| 5218. | CTGGTGGGAAGCGAAGGTGGTGCC[G,A]CGCCGGGAAGTGAACTCGAGAAACC | 2,097,965 | 84 |
| 5219. | TTCAGACACTACAGTTATAGGCTA[G,A]AGGTGAACCATTGCATTAAGAACAA | 2,099,347 | 84 |
| 5220. | GAAATTGCATGCTTCAAAGCATTT[A,G]CCTTTCCATTTACAAAAATCAACAG | 2,099,551 | 84 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 5221. | AAAATTATTTAAGAAAACTTAGGG[T,C]GAGGACCACTTGACATCAAATGCTG | 2,099,639 | 84 |
| 5222. | ATAATGTGAAAATCAGTGTAGTGA[G,A]AAGTAAATTATAAATAACTAGTGTA | 2,099,773 | 84 |
| 5223. | ACACACACACACACACACGTAT[G,A]TATTAACATAATGTGAAAATCAGTG | 2,099,805 | 84 |
| 5224. | GTTATTAGAATTCCTGTTCAATGA[T,G]ATTCTTTTTCCAAAGAACCCTAACA | 2,100,008 | 84 |
| 5225. | CCCACCCAATGAGTTATTAGAATT[C,G]CTGTTCAATGATATTCTTTTTCCAA | 2,100,020 | 84 |
| 5226. | TTTTTTCAGAATACAAGGAATCCT[T,G]AGTTTACTTCCGCCAACTCATACCA | 2,100,196 | 84 |
| 5227. | AACAAACATTCCGGAACATGAACT[C,T]GTGCTATATAATTGACTTGAAAAAT | 2,100,376 | 84 |
| 5228. | CCAAGTCCCAAGTGTTTGGCATTA[C,T]AAAGAATAGAAGATAGACTCTAGCA | 2,100,629 | 84 |
| 5229. | TCCATAAAGTAGAATATTCAAATG[C,T]CAAATAGCATAAGCATATGACAATT | 2,100,855 | 84 |
| 5230. | CATGAATAATAGGCCAATACCTTC[A,G]AAAGAAGAGTGGAGGGAAATCGTTA | 2,105,126 | 84 |
| 5231. | TCCAATAGGGATGGAAGTCAAAAT[C,T]CGAAAGAGCCTCCTTCATGAAGCGC | 2,105,533 | 84 |
| 5232. | ACTCCAAACGTATGCCATAGTCCA[A,G]TCTATCCAATAGGGATGGAAGTCAA | 2,105,562 | 84 |
| 5233. | ACAGCACGAAGAGCTCGCGAAAGG[A,G]CATCAGCACATATAATAAAAAGATA | 2,105,699 | 84 |
| 5234. | AAAGCCAATAGCATTCCAGAACGT[G,A]GCCCATCCCAACAGCAAGCAATCAT | 2,105,823 | 84 |
| 5235. | CGTTATGCTCGGCCACACCTAACC[G,A]ATCTCGAATCAAGTGCTGCAATTGC | 2,105,962 | 84 |
| 5236. | ATCCCCAAATACTGAAGAACCCCG[T,C]TATGCTCGGCCACACCTAACCGATC | 2,105,984 | 84 |
| 5237. | ATAATGTTCGAAAGTAAATAAACA[G,A]GCATAGAAGTGAGAATGGACCTCAT | 2,106,152 | 84 |
| 5238. | CATGCTAGCAGATGTACACCACCA[T,C]CCCTTTAGATTTGGAACGCCACAAG | 2,106,250 | 84 |
| 5239. | TACTAGTTGGCAGACCATATCTCA[T,C]GCTAGCAGATGTACACCACCATCCC | 2,106,272 | 84 |
| 5240. | CCTTCTATACTAGTTGGCAGACCA[T,C]ATCTCATGCTAGCAGATGTACACCA | 2,106,279 | 84 |
| 5241. | ATCATGCTCTACATCGACTCAGGG[T,C]CAAGTAGAAGCTTGGCAGTATGTCG | 2,106,379 | 84 |
| 5242. | CGCCGCATCATCATGCTCTACATC[G,A]ACTCAGGGTCAAGTAGAAGCTTGGC | 2,106,388 | 84 |
| 5243. | AGGAACACATTAGGGGCATGCACA[C,T]AGATCTCCTACCATATAACTGAAGC | 2,106,486 | 84 |
| 5244. | TGAAGGAACACATTAGGGGCATGC[A,G]CACAGATCTCCTACCATATAACTGA | 2,106,489 | 84 |
| 5245. | TAACATCCGAGCCATGATGAAAAG[G,A]TGTAGGAATCCTCAGTACTCATCGG | 2,106,737 | 84 |
| 5246. | AAAGATTAACTCTCGGGTGCACTC[C,T]GAGCCTCCAAATCCATCCACCATCC | 2,106,869 | 84 |
| 5247. | CGCAAATAAGACCTGATCGAAAGA[T,C]ATCTCCAAGCTACCTTCCACAAGAA | 2,106,918 | 84 |
| 5248. | CTAGCTGGTATCCAAATCTCTCTC[A,G]CGCAAATAAGACCTGATCGAAAGAT | 2,106,943 | 84 |
| 5249. | CGTCTCCTCCTCCCTAGCACAGCA[G,A]GAACACTCTAGCTGGTATCCAAATC | 2,106,975 | 84 |
| 5250. | CACCCCCTACTCTTGATCTTAGTC[G,A]GTCTAAGAAGGCCCCAACAGGATCA | 2,107,108 | 84 |
| 5251. | GCAGCATTGATAACTACATTGTGG[A,G]ATAGAACACCCCCTACTCTTGATCT | 2,107,139 | 84 |
| 5252. | TGTGGCTCTCTTCAAAATGAACCA[T,A]GCCGAGGTCATTCTGGATTCAAAAA | 2,107,230 | 84 |
| 5253. | TTCACCTTAAAGTACCTCGGAGGA[A,G]AGGACTCCCAAATGATAAACACCTT | 2,107,361 | 84 |
| 5254. | AGAGTACAAAACCTGCACCTCCAA[A,G]CCTGCCGTGAACGCTACCATCAAAG | 2,107,411 | 84 |
| 5255. | ACGTCGCAACCTAATCAACTATATAC[C,A]GTTGGCCTTCCGGAGAGCATGTCGG | 2,107,704 | 84 |
| 5256. | AACCTCGGATCAGTCTCCAAAAAT[T,C]CATCGGAGTGTTCCACAACGAACGT | 2,107,750 | 84 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 5257. | CAGAAAGTGAAACATCCTTGAAAG[A,G]CCAAGGAATCAACCTCGGATCAGTC | 2,107,785 | 84 |
| 5258. | ATACGGAAATCAAACATCCACGGT[C,G]TAGGGTGACTCTACGAGTCCAAATA | 2,108,077 | 84 |
| 5259. | GAuGTTCTAGAAAGGTAATAAACT[T,C]GTTTTGAAATATGCCGAGAGTACGA | 2,108,395 | 84 |
| 5260. | GAAAGAATGAGGTAGAAAAGCATT[T,C]CTTGAAAAGAAAGTTCTTTCTACCA | 2,108,459 | 84 |
| 5261. | TCGATCTGATAGATCGCTACAAAT[T,C]GATTTATGAATAATGATAAATTTTC | 2,108,724 | 84 |
| 5262. | GAATGTACAATTCTGCGGTTTCCT[T,A]AGTCATCAATTGTGGGCATTTTTTT | 2,110,260 | 84 |
| 5263. | AACCTTCCCATCCTTCGTTGTAAG[C,A]AGTCTTATTGTTGTATATGAATGTA | 2,110,303 | 84 |
| 5264. | ATAATTTGATTCCTAAAGCTTCCC[C,T]AGCAGCACCTTTCATTCATGTATTA | 2,111,002 | 84 |
| 5265. | TATTAATCTCATCTGAATGGTATC[G,A]TGTAAAGATTAGATTATATCAACAA | 2,111,990 | 84 |
| 5266. | TGGCCAAACGTTAGCAGAACCCTA[C,T]CAGTTGCCACCCCTATACTGTGTGC | 2,112,476 | 84 |
| 5267. | GGCTTTCGGATGGATATGGCCAAA[C,T]GTTAGCAGAACCCTACCAGTTGCCA | 2,112,492 | 84 |
| 5268. | TGGATATGGATGTAGGATTATAGA[T,C]AGGGGTTGGGTCTGACATATGTACT | 2,112,544 | 84 |
| 5269. | CACTGTTTTACAAGTAGTGTTCCA[A,G]CAATCCTAACTTGTATGCCTTATCA | 2,114,922 | 84 |
| 5270. | TGACTTCGGTTGCCTCTTCTTCTA[C,T]GTGGATTAACTGATGCAAAGTGATC | 2,115,107 | 84 |
| 5271. | CATGCTTTGGCAGTCATCTGACTT[C,T]GGTTGCCTCTTCTTCTACGTGGATT | 2,115,125 | 84 |
| 5272. | CAAAAGCTATTCTCTTTAGCTTGC[G,T]GAGGCATCATTACTTTTCCTCTTCA | 2,115,436 | 84 |
| 5273. | CATTCAAGTGTATAATAGTTCCTT[T,C]TGTAGTTTCTACAAATCTCAGGATC | 2,115,584 | 84 |
| 5274. | AACTAATCTCTCCCTCTCTCTC[T,C]AACAAGTCCATTTAACATTTTAATT | 2,116,191 | 84 |
| 5275. | AAATATTCGATGTCATACCAGATT[T,C]TCTACCATCATAATACAAAATAATG | 2,116,329 | 84 |
| 5276. | CACTTCTGGCCTTATAGTTTGAAT[A,G]TTGTGGGAATAAGGCCTTATAGTTT | 2,116,395 | 84 |
| 5277. | TGGTACCTGTGAGATTCTCCAAAA[T,C]GTATCCTCTTAGTTTATATTAGCTC | 2,116,444 | 84 |
| 5278. | ATTTCATTCCGTGATTGCACTCCT[A,G]CTCTTCTTATCTGAAATTCGAAGAT | 2,118,327 | 84 |
| 5279. | ACCAAAGAAATAATGAACACCGAT[A,T]AGAGTTCTAGATATCGAGAAAAGGA | 2,118,444 | 84 |
| 5280. | TCATTACTGTCCATCATGGAATAC[T,C]ATACCGTCCCATACCGCCCGTAGCA | 2,118,655 | 84 |
| 5281. | AACCAAAATTATATGATACTTTCT[C,A]ATAGTTTAGAACAGAAAATACTACA | 2,120,420 | 84 |
| 5282. | TGAGCCAAATCACATGTAGAGAGG[C,T]AAGTGGTTGCGGGTGCTGGGGACTT | 2,120,476 | 84 |
| 5283. | GCAGTTGTAGAATATATGAAAGAA[G,T]GGTGCATGTAATTGTTGTAAGCTTG | 2,121,161 | 84 |
| 5284. | CTTTTATGGAATTTCGGTTGAATC[G,A]TGATACAGCACAGCCTTCTGCACTT | 2,121,232 | 84 |
| 5285. | TTTGGAGGATTATTAACTTGTCTA[A,G]TCTTTGACCACAACTTGGTGGAAAG | 2,121,312 | 84 |
| 5286. | CATAAGGGCATAGCATTCCAACAA[C,T]TATTTATACTTCAGAATTCAGGTGG | 2,121,868 | 84 |
| 5287. | CATCCACCTGTTCATTTTCGGTAG[T,C]TATAATTCCACCAAAGAATTGATAT | 2,122,435 | 84 |
| 5288. | GCAGAGATTGGTGATTGTTAGACT[T,G]ATCACCATTTTGCACTTCAGCTTCT | 2,122,730 | 84 |
| 5289. | TTGGGTAGCCAAGATCAACCAATT[A,G]TAAGTGGGTGGGGTATGGATTTGAC | 2,124,017 | 84 |
| 5290. | TTATATTTAGTGTTAATTCATTAT[A,T]GTTGTTCTTGAACTTTTTACTGTTT | 2,125,059 | 84 |
| 5291. | CCGGCCGGCACGAGTTCCAATACC[G,A]AGTCCGCGAATCTTGATTCAATATT | 2,125,202 | 84 |
| 5292. | GAGCGCCCTTGTTTCATGCTTGCA[G,A]CACCACAGGTATCAAGTGCGCCGTT | 2,125,433 | 84 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 5293. | GCTATCGAAGGGCGTCGGGTCGCT[G,A]CCGTGGCCACCGCCCACCGGGCAGC | 2,125,685 | 84 |
| 5294. | GATCGTATTGGAGGGAGGAGCGAA[C,T]GGTGGAGGAGCTATCGAAGGGCGTC | 2,125,719 | 84 |
| 5295. | AGAGAGAGAGGGAGAGCGATCGTA[T,C]TGGAGGGAGGAGCGAACGGTGGAGG | 2,125,736 | 84 |
| 5296. | ATCACGACGCCGTCGGAGGCCGAC[G,A]GTGGCCTGCTGTGGCCATCAGAGGG | 2,125,844 | 84 |
| 5297. | TCAAAAGAATGGCAATCTAATAT[A,G]ATCATTCAATACATAAAATTTCGTA | 2,126,026 | 84 |
| 5298. | GCTTTTTGTACTTTATGCCGACAA[C,T]GTTGTGGATGACTCAGTAAGGTGTG | 2,127,146 | 84 |
| 5299. | GGGATTACTAACACTTCAAAGGAA[C,T]CTTAATGAACTCTCCTTAATTTAGT | 2,128,887 | 84 |
| 5300. | CATTTTCTATGCTCTCAAGGGCAT[T,G]CTGGGATTACTAACACTTCAAAGGA | 2,128,914 | 84 |
| 5301. | CCTATACCTGGTCATGTCCTTTTC[G,T]CAATAAATTATAACAAGCAAGAGAC | 2,130,403 | 84 |
| 5302. | GGAGTTTTGGAAGGAGAAATAAAC[A,G]TACTCTAGGGGAAGGTCAAAGGAAC | 2,130,583 | 84 |
| 5303. | GTTGAATATATGACTTAAAGACAA[A,T]ATCTGGAACAAAAAAaGAAAAaTG | 2,132,387 | 84 |
| 5304. | CAATCTGGCACAACCTGGTCTTCT[A,G]CTCTATTTGCACCTTTCTCTTCAAA | 2,132,513 | 84 |
| 5305. | ATCCACCAAGCTAGCCATCTTGGA[C,A]GAAGAAACATAGATCAACACCATTC | 2,133,229 | 84 |
| 5306. | TAATTCTTCCTTCTCTTGTGGCTA[G,A]ATAGTTTCTCTGCTAATATGTTTGT | 2,133,507 | 84 |
| 5307. | GTCCCCTTATTAAAGAATCATTAA[G,C]GTTAAAAAAATGCAACTCCGTTCGG | 2,133,841 | 84 |
| 5308. | TCTCGTTGCTGGTAGGCTTTGTGT[C,T]CCCTTATTAAAGAATCATTAAGGTT | 2,133,863 | 84 |
| 5309. | CCATCCCGCCTCTTCTCTCCCTGC[C,T]GTCGGCTCGGCTGCCGTTCTCTCTT | 2,134,491 | 84 |
| 5310. | ACTTGAGCTATCCGAAGAGAAACA[A,G]TTTTTCTTTCCTTCAAATTAAACTA | 2,136,184 | 84 |
| 5311. | TTTCTTATAGCGTCTGGCATGTAT[A,G]CAAAGTAGAGGATCTGCACATCCAG | 2,136,348 | 84 |
| 5312. | TTGCGAAGATCGAAGTTTATCCTG[T,C]TTTCTTATAGCGTCTGGCATGTATA | 2,136,373 | 84 |
| 5313. | GGTGTCACACCAGTATATCTTCTC[C,T]CTCGTTTGATTGGGTTGCGAAGATC | 2,136,412 | 84 |
| 5314. | TGAGTTAGGAGTCCTATATTTATT[G,A]GATCATGGGATTCATCTATAAATAG | 2,137,204 | 84 |
| 5315. | CTCTTATGGGCCGACCAACACCTG[G,A]AAGCTTCCTTATTGTGGACGTCCCA | 2,137,358 | 84 |
| 5316. | ATTCGAATCGGACCCATTTTGGAT[G,A]AAGCTTCCTTATTGTGGACGTCCCA | 2,137,419 | 84 |
| 5317. | TAAAATTGACAGCCTTTCGAAATT[G,A]TTTCGAACCAGCTTCGAATTGAATT | 2,137,466 | 84 |
| 5318. | GTACTAATTAATTTTAGATTATAT[T,C]TAAATTAATTAGACTTAATTGGATC | 2,137,558 | 84 |
| 5319. | ATATGATCTATGGAGTATATGAAA[T,G]ATTGGATTTAAGTACTAATTAATTT | 2,137,594 | 84 |
| 5320. | CACATGAGGTTCAAGTTCGATCAC[G,A]GAGATGAACAGTTTTCGATATATGA | 2,137,638 | 84 |
| 5321. | GAGAATTAAGTTATGGATCGAATG[G,A]GATTGAAGAGTTGACTATGTCTAGC | 2,137,696 | 84 |
| 5322. | AGTCACACACACAAGTCAAACACC[A,G]TAGGAAAGAATTAGCTTATATTTAT | 2,137,798 | 84 |
| 5323. | AGTACAGAAGTCGGTTCCTGTGCT[G,A]CTGGCTTAGTATTTAAACCTATGGA | 2,137,847 | 84 |
| 5324. | GTATAGATTTTGAAATATTTTTTT[A,G]TGATAATTTGACCTATTTGGACGTC | 2,137,926 | 84 |
| 5325. | CAGGGTCAAAAGAATGAATTATAC[G,A]GTAACCATGTGTATAGATTTTGAAA | 2,137,961 | 84 |
| 5326. | AATCTGAAACCATCCTAGAGCATT[C,T]AGGGTCAAAAGAATGAATTATACGG | 2,137,985 | 84 |
| 5327. | ATTGACAGTTAATCTGAAACCATC[C,A]TAGAGCATTCAGGGTCAAAAGAATG | 2,137,995 | 84 |
| 5328. | CTTAATCAGGATAATCTATGAGAT[G,A]GATTTGAAAGGTTGAAATACAATGT | 2,138,061 | 84 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 5329. | ATATGTAGATCAAAATGGGATTGA[T,C]CCCTTCAGATTATTGGAGTTGATGT | 2,138,137 | 84 |
| 5330. | TATAGTTAAGTACTTGTGAAGTCT[A,G]TATGTAGATCAAAATGGGATTGATC | 2,138,161 | 84 |
| 5331. | AAGTATCTTTCAGTTCTAAGATCA[T,C]CATAGTGACTTGCAAATAATTCTGT | 2,138,264 | 84 |
| 5332. | CAAGGACTGTGGTGACACTGATAT[A,G]ACATACAGGTGTGATATAGGAGTAC | 2,138,386 | 84 |
| 5333. | TGATACGTCATTATAGAATGCTAA[C,T]ATTTATCGAGTGGAAGTCATTGTGT | 2,138,463 | 84 |
| 5334. | AGTCCTTAGAACTATATTAGTGTA[T,C]GATAAAGAGAGAATTTATCGTATAG | 2,138,537 | 84 |
| 5335. | TGAACTCTTGTATTGTGATGAAGT[C,T]CTTAGAACTATATTAGTGTATGATA | 2,138,558 | 84 |
| 5336. | TGATAAATGAATAAAAATTATTCT[G,A]ACATTTTTTCATCACAAAGTTATAT | 2,138,614 | 84 |
| 5337. | AATGGAAGATGGGTATAAGATACT[G,A]CCCCGATTGACTTTAGTCCAAGTTG | 2,138,732 | 84 |
| 5338. | CCGACCCCTTTACTAAAGCTCTCG[G,A]GATCAAAGCGTTCGATGACTTCAAA | 2,138,780 | 84 |
| 5339. | CAATAGAAAGGAGAACCTAGCCGA[C,T]CCCTTTACTAAAGCTCTCGGGATCA | 2,138,800 | 84 |
| 5340. | GCATCAGATATTGCAAAATATTCT[A,G]CATCGCTATTACTTGGTGCGAGAGA | 2,138,884 | 84 |
| 5341. | TCTGTATGCAAAACAGAATACAAT[G,A]CTGCATCAGATATTGCAAAATATTC | 2,138,911 | 84 |
| 5342. | AAGAATTTCAAGCAACATACTGTG[A,G]TCGATTCTGTATGCAAAACAGAATA | 2,138,941 | 84 |
| 5343. | TAATGGAGGAGCTATTTGTCAGAA[G,A]AATTTCAAGCAACATACTGTGATCG | 2,138,963 | 84 |
| 5344. | TTATGATGACAGCAGAAGCGTGTC[A,G]AGCTATGTATTTATCTTAATGGAGG | 2,139,004 | 84 |
| 5345. | CGGCAACTCCTGAGGAGAGAGCGC[A,G]TATGAGTACAATACCATATACTTTG | 2,139,272 | 84 |
| 5346. | ACTCTTTTCAAAAAGATTGTCCG[G,A]CAACTCCTGAGGAGAGAGCGCATAT | 2,139,294 | 84 |
| 5347. | AGGGATAAATTTAGAAGATTGCTT[G,A]GATTATCCTAATCCATGTACATCAA | 2,139,411 | 84 |
| 5348. | GAATGAAGATCTATAGGGATAAAT[T,C]TAGAAGATTGCTTGGATTATCCTAA | 2,139,425 | 84 |
| 5349. | AGTGTAAAGCTATAGTTATCATCA[T,C]AGTTTTTCATGAAGAACTTGGGAGA | 2,139,492 | 84 |
| 5350. | TATGTGGATGATATACTGTTACTA[G,A]AAAATGACATCCCGACTTTGTAGAG | 2,139,540 | 84 |
| 5351. | TGTACTATATGTGGATGATATACT[G,A]TTACTAGAAAATGACATCCCGACTT | 2,139,547 | 84 |
| 5352. | CTTTGCGTCTACAAGTGGGCTTCC[G,A]ATTCTGTAGTCATCTTTCTTGTACT | 2,139,591 | 84 |
| 5353. | ACAAGCTAAATAGGTCTATTTATG[G,A]ACTTAAACAGGCGTCTAGAAGTTGG | 2,139,698 | 84 |
| 5354. | CATCCATAGATGAGTCGAAAATGT[A,G]CAAGCTAAATAGGTCTATTTATGGA | 2,139,722 | 84 |
| 5355. | CTGGAAGAAGAGGTGTATATGATA[C,T]AATCTGAAGGGTTCACATCCATAGA | 2,139,762 | 84 |
| 5356. | TCCTGTGGCAATGCTCAAGTCCAT[T,C]CGAATTTTGTTTGCTATCGCTGCAC | 2,139,868 | 84 |
| 5357. | TATAAAGCTCGTCTAATTACTAAG[G,A]TTTACCATCAACATTATGGTATTGA | 2,139,936 | 84 |
| 5358. | GTATGGACACTAATTGATCCATCT[G,A]AAGGGATAAAATTCATAGGATGTAA | 2,140,032 | 84 |
| 5359. | GAGATGGAGTCTATGGAGATCCAT[A,G]GTGTATGGACACTAATTGATCCATC | 2,140,059 | 84 |
| 5360. | GGGCCCGACTCTCAGAAATGGCTT[G,A]AGGCCATAAAGTCCGAGATGGAGTC | 2,140,098 | 84 |
| 5361. | TGGATAGATACTATGATTTTTTtG[G,A]TCCAGAATGATGATTCCATTAAATT | 2,140,183 | 84 |
| 5362. | AATCAAATCTGGAGCCAATAGAGG[T,C]GCTATTAAGGAGATCCGGTAGAGTA | 2,140,243 | 84 |
| 5363. | TTGATTGATGAATCAAATCTGGAG[C,T]CAATAGAGGTGCTATTAAGGAGATC | 2,140,253 | 84 |
| 5364. | GACACACACAGAATTGAATTTGAT[T,C]GATGAATCAAATCTGGAGCCAATAG | 2,140,272 | 84 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 5365. | AGTTCTTTAGTGAAAGAGCTAATG[C,T]CTGTAAAATTGAATTTGATGAAGTT | 2,140,339 | 84 |
| 5366. | GTTTGCAGTTGGACAGTCTTTTTG[G,A]AAAAAGAGTTCTTTAGTGAAAGAGC | 2,140,370 | 84 |
| 5367. | CGATAAAACTCTATATGAGATATG[G,A]ACTTGGCGTAAGCCGGTGCTCTCAC | 2,140,561 | 84 |
| 5368. | TAGAGATATGCTCTTGAAACTGCC[T,C]GTTATATTTTGAATAAAGTGCCGAG | 2,140,620 | 84 |
| 5369. | CACAACATAATGCGATATCTAAAA[G,A]GAAAAATCAAATCTTGTTAGATATG | 2,140,712 | 84 |
| 5370. | CTCTTGGAGCACCACAACATAATG[C,T]GATATCTAAAAGGAAAAATCAAATC | 2,140,724 | 84 |
| 5371. | GAAGTAGAGAAATAGATTGGAAAG[G,A]GTATTAAGACCCTTCGGTCAGACCG | 2,140,845 | 84 |
| 5372. | TATTTGAAATATTCAAATGATTTC[A,G]TGCTGAAGTAGAGAAATAGATTGGA | 2,140,874 | 84 |
| 5373. | GATGACCTATCGAGGTATGAGTAT[G,A]TCTATCTTATGAAGCATAAATCAAA | 2,140,926 | 84 |
| 5374. | TTTACAGATGACCTATCGAGGTAT[G,C]AGTATGTCTATCTTATGAAGCATAA | 2,140,932 | 84 |
| 5375. | TAATACATACTGATGTATGCGGAT[G,T]TATGAACATAAGTGCCAGAGGAGGA | 2,141,000 | 84 |
| 5376. | GATCTAATACATACTGATGTATGC[G,A]GATCTATGAACATAAGTGCCAGAGG | 2,141,004 | 84 |
| 5377. | CTACTTGGTAAGATGACTAAGTCA[T,C]CTTTTAAGAGAAAAGGTGAAAGAGC | 2,141,067 | 84 |
| 5378. | TGAGATAGATGATTGTGAATCATT[A,G]CCAACCTACGAATCTCGTCTACTTG | 2,141,110 | 84 |
| 5379. | ATATCCTAAATTAGATAATGTCAG[C,T]GAATCCTACCTTTGGCATTGTAGAC | 2,141,212 | 84 |
| 5380. | CACGACCTGTTAGTATAATGTACA[G,A]CCAACAAATATCCTAAATTAGATAA | 2,141,244 | 84 |
| 5381. | GATTTTTATGATATCATTATGAAT[A,G]ATACTGCAATTATGTGTGGATAAT | 2,141,317 | 84 |
| 5382. | TTTATAATAAAGGATGATTTTTAT[G,A]ATATCATTATGAATAATACTGCAAT | 2,141,332 | 84 |
| 5383. | GCCTTTTGGCCAAACTTAGTTACA[A,G]GTTTATAATAAAGGATGATTTTTAT | 2,141,358 | 84 |
| 5384. | AATATCATCTCTGTAGGCCTTTTG[G,A]CCAAACTTAGTTACAAGTTTATAAT | 2,141,374 | 84 |
| 5385. | CAGCTTGTCTTCTAATCCAGTAGT[G,A]TCATGTTAGATAATTATCACTATTG | 2,141,440 | 84 |
| 5386. | TTCAGTTCTAGTCTTGAAAACTTT[A,G]CAGCTTGTCTTCTAATCCAGTAGTG | 2,141,465 | 84 |
| 5387. | GAAAaGATACAGAAATCCCATGC[C,T]ACCGATCCTAAGCAGAGTAAATCAT | 2,141,821 | 84 |
| 5388. | AAAaAGAAAAaGATACAGAAATCC[C,T]ATGCCACCGATCCTAAGCAGAGTAA | 2,141,826 | 84 |
| 5389. | AGGAGTTAGTGAATTAGTGAGAG[G,A]ATTATCTACAGGACATCGATCCTTT | 2,141,885 | 84 |
| 5390. | CAGAAGGAGTTAGTGAATTTAGTG[A,G]GAGGATTATCTACAGGACATCGATC | 2,141,889 | 84 |
| 5391. | GAGGCTTTAGTCACCAATCATGTA[C,A]TGTACATAATTGAGCAGATTGAATA | 2,142,111 | 84 |
| 5392. | GCAGCTATGAATGACAAACTTAGT[C,T]GTAAGTTCAAAGATGCGCAGGTAGA | 2,142,258 | 84 |
| 5393. | AAACCTACAGTCAATGCTCCTCGT[G,A]CCGTGAGAGATACTTACATGAAGTG | 2,142,345 | 84 |
| 5394. | AGAATTAATGTAATTTTCGAATTG[G,A]AGGTAGAGGCTATCAATTCATAAAA | 2,142,623 | 84 |
| 5395. | TCTAGTACCCACTAAAGAATTAAT[G,A]TAATTTTCGAATTGGAGGTAGAGGC | 2,142,638 | 84 |
| 5396. | CACAGTCAGATCCGAATGCAGTCT[G,A]TGTGGATTCTAGTACCCACTAAAGA | 2,142,670 | 84 |
| 5397. | GGGGTAAAACCTAATTGCTAGAAA[T,G]TATTTGAAAAAATAATTGATTATGA | 2,142,753 | 84 |
| 5398. | GCCTGGGGTAAAACCTAATTGCTA[G,A]AAATTATTTGAAAAAATAATTGATT | 2,142,757 | 84 |
| 5399. | CTCAGGTTGATCGAGCCACACTCG[A,G]ATTTGAATATCCATTTGTTAGATAC | 2,142,882 | 84 |
| 5400. | CATTCATCATATGACCATCATGAT[A,G]TACTTTCAGATCAATACTCAGGTTG | 2,142,923 | 84 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 5401. | TTGATCATAGCCTCCTATTAAGGT[G,A]CGTGATAATGAGTCGAATATTTCAA | 2,143,024 | 84 |
| 5402. | CTATATAACTTGATGAAGTTAGTG[A,G]GAGGATTTGCAGCTTGTAGGTCATC | 2,143,153 | 84 |
| 5403. | TTTGATTAGGTCACTAGTCTATTC[G,A]TGCAGACCCATGCTATTAAGGTGAA | 2,143,251 | 84 |
| 5404. | GATCATGGCTCCGTGGTTGAGCCC[G,A]AATCTTCTGATGGACCAAATCGAAA | 2,143,451 | 84 |
| 5405. | CATGATCATGGCTCCGTGGTTGAG[C,T]CCGAATCTTCTGATGGACCAAATCG | 2,143,454 | 84 |
| 5406. | TTGATCAAGTCCATATGTTTGATC[C,T]AATAAATGGATCATGATCATGGCT | 2,143,491 | 84 |
| 5407. | CAAAGGATTAGTTTGAATCAGATC[T,C]TTTTAATGGGTTAGACCTAGGGTTA | 2,143,640 | 84 |
| 5408. | ACAGATTAAAATACATGTTTGACA[C,T]AATTTTGAATTAAGCTTTGAATGAT | 2,143,738 | 84 |
| 5409. | GATCATACCTATATATGTTTAATT[G,A]TTGAACATATTATAAAAATTTATTT | 2,143,842 | 84 |
| 5410. | TTATCATGATGCATGAGATGTATG[T,A]ATGAAGTTTAGATCATACCTATATA | 2,143,877 | 84 |
| 5411. | GAACAAATTTTTATATATTATTTT[A,G]ATCAAAATATATTTAGATTAGATTT | 2,144,030 | 84 |
| 5412. | TCTCTTTTATCTATTCGATGGGTT[C,T]TCTTATGATGTGTAGGGGTGTCATT | 2,144,109 | 84 |
| 5413. | ATCATAGAGATTAATTTCTCTTTT[A,G]TCTTATTCGATGGGTTCTCTTATGAT | 2,144,125 | 84 |
| 5414. | TTGATGAGATCACTAAACCATCCG[G,A]TCATAAGAGATCATAGAGATTAATT | 2,144,159 | 84 |
| 5415. | TATAATTAATAAGATCAAGGATAT[G,A]TTCATGACATAAAAATTATTTTATC | 2,144,276 | 84 |
| 5416. | AATATTTTATAATCAGTATAAGAT[G,A]TGTTTCAGATTTGATATGATGTATC | 2,144,351 | 84 |
| 5417. | CGCAAAAATAGATTTTATCAGAAA[T,C]TTATTCCTCATACATTCATGTTTGC | 2,144,439 | 84 |
| 5418. | AACCCCTCTCCAGTGTCAAAGTCT[G,A]AGTCCCCTCCTTCAATGATTTTAAT | 2,156,359 | 84 |
| 5419. | TGCTCCCGTAACTCTATATCGAAC[G,A]CCCACAACCCCTCTCCAGTGTCAAA | 2,156,389 | 84 |
| 5420. | GAGACATAAATACATCAGGCATCT[C,T]AGTCCATAATGAGTTTGAGTCTGCT | 2,156,435 | 84 |
| 5421. | TCTAATTTTTATAGTAATTTCTGT[T,C]TAGTCAATTTGGTGAGGAGTTGATG | 2,156,495 | 84 |
| 5422. | TAATATTTTGACTCTAATTTTTA[T,C]AGTAATTTCTGTTTAGTCAATTTGG | 2,156,508 | 84 |
| 5423. | CAACCACCATGTTTATCTCATAGG[C,A]ATCATTGTGAGAATTATGGAGAAAT | 2,157,685 | 84 |
| 5424. | ATATATTTTACATGTATGAAAAAT[G,A]TCTTCACTTATCGATCTATTAATCC | 2,157,829 | 84 |
| 5425. | ATACTAGATTATTGTAGAAAATA[G,A]AAATATTTATTCACAACAATCCGAG | 2,158,169 | 84 |
| 5426. | TTCTTTTCTTTAATATACTATATT[G,A]TCTTTTATTGCATTTGAACTTTTAT | 2,158,315 | 84 |
| 5427. | TATAGCACTAAATTGGGTCCATCT[A,T]GATTTAATAGGGTCAAAATCCATTT | 2,158,524 | 84 |
| 5428. | ATAAGATATTTGATAAAAAATTTA[A,G]TGCTTTATATTATGTTTGCCCTACC | 2,158,630 | 84 |
| 5429. | GTGGGTCTACTTTCCTTCTCTCAG[T,C]GGGAAAAATTTTGGTAGATCTTAAA | 2,158,750 | 84 |
| 5430. | TTTAGTGATATTTGCAATTCAAGT[G,A]GGTCTACTTTCCTTCTCTCAGTGGG | 2,158,772 | 84 |
| 5431. | CTTGAGTGTTACTAACATTCTATT[G,T]CTATAAACTTCATTTATTTTAGTGA | 2,158,814 | 84 |
| 5432. | TTTCTTTAAACTATTATAAGAAAG[C,T]GTTAGAGTAATAGATGCTCTTGAGT | 2,158,857 | 84 |
| 5433. | TATTTAAAAACACTTTTGATCAAA[C,T]ATTGTTATATTATATATTTTTATA | 2,158,910 | 84 |
| 5434. | GTGTCAACCAACAATTAGCTTCTA[G,A]AGCACATATCTAACATAAAATTTTT | 2,159,007 | 84 |
| 5435. | GTATAAAGTTTTGTTCTGAAATTA[T,C]AAAATGTGTCAACCAACAATTAGCT | 2,159,037 | 84 |
| 5436. | TTAATTTTTAAGACAAATCATGGA[C,T]ACATAAATATAATTGAAATAAAAAT | 2,159,117 | 84 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 5437. | AATTCTCAACATCTTGAGAATATA[C,T]AAAAATTATTTTTATTAATTTTTAA | 2,159,156 | 84 |
| 5438. | GATTCTTTAATTGAGAGCATTTAG[A,G]AACTAACCATTAATTAATGCATGTC | 2,159,209 | 84 |
| 5439. | TCACTATCCCTATGACGATTCTTT[A,G]ATTGAGAGCATTTAGAAACTAACCA | 2,159,225 | 84 |
| 5440. | TGCACTCTCATCCCAGTGTCTCTA[T,C]ACCGCAGATCTGAGACTTATCTATC | 2,159,316 | 84 |
| 5441. | GGTCACGCTCAGTGCAAGTTGTTC[C,T]CTAACAACCACTGGCCTGCACTCTC | 2,159,357 | 84 |
| 5442. | AATATATACAGCAAGAATCCGAAT[G,T]GCTAGAGACCAAGAAAACGTACAGT | 2,159,527 | 84 |
| 5443. | CAAACAGCAAACCTGAACCTACTG[T,C]AGTCAATATATACAGCAAGAATCCG | 2,159,556 | 84 |
| 5444. | ATAATCCATCAGTGCACACCTAGCA[A,G]TATGTAGTGACAATTCAATAAAATA | 2,159,874 | 84 |
| 5445. | AATAGGATTTCAATAAATTCTAAC[A,C]CAATTACAACTTCACAAGTCTAATT | 2,160,101 | 84 |
| 5446. | CTTTCTTGATTCCAAATCATTATC[C,T]AATCAGGCTAAAAAGATTAGATCTT | 2,160,707 | 84 |
| 5447. | CTAAGAGACCATCTTCTTAAATAG[G,A]CCTTTCTTGATTCCAAATCATTATC | 2,160,733 | 84 |
| 5448. | TTAAAATTCAATCTTTTAGAATCC[T,A]AAGAGACCATCTTCTTAAATAGGCC | 2,160,756 | 84 |
| 5449. | AGAAGAAGGAGAAAGGATGAGGCA[A,T]GGAGATATGGCAGGACGAGTTTAGA | 2,160,810 | 84 |
| 5450. | CCCTTGGGCATAGGAAAGAGAAGA[A,G]GGAGAAAGGATGAGGCAAGGAGATA | 2,160,828 | 84 |
| 5451. | TCTACAGATATCCACTAAGATCAA[T,C]CTTGAATCTTTCTTTCCATGGTAGA | 2,161,034 | 84 |
| 5452. | TCATCACTATCGATGATCTTAGAT[C,T]CGAAAGTTCTTGAGCCGTACACGTG | 2,161,091 | 84 |
| 5453. | AAAAATAAAATAAAAGATGAGAGT[G,A]AATCTCTATACATTTATGTAGGTTA | 2,161,145 | 84 |
| 5454. | AATCTAAAAATAAAATAAAAGATG[A,G]GAGTGAATCTCTATACATTTATGTA | 2,161,150 | 84 |
| 5455. | TTTAAAGTGTTAGAAAAATCAGATA[A,G]GATGTATGCATAGATTTCAAAAATT | 2,161,301 | 84 |
| 5456. | TACTAATTAATTACTATTTAATCA[G,A]AAAATATTATCCTCATAAGGTACTA | 2,161,421 | 84 |
| 5457. | TCATTGTGGGCTGAATCTCGAGGC[A,G]TCAAATCCTAACAATGATAAATAGT | 2,161,497 | 84 |
| 5458. | CTCATTGTGGGCTGAATCTCGAGG[C,T]ATCAAATCCTAACAATGATAAATAG | 2,161,498 | 84 |
| 5459. | TTACATACATATTTAGTGATTAAA[T,A]ATTATCATTGCAAAAAATCTAAATC | 2,164,896 | 84 |
| 5460. | GCATGCAAACTTCACTATGAAAAA[G,A]AAATTTTACAAGAGGAGACCTCACC | 2,164,896 | 84 |
| 5461. | ATATTTATTTTTAAAAACTTACAT[A,G]CATATTTAGTGATTAAATATTATCA | 2,164,914 | 84 |
| 5462. | ATCAATGTGTCTAGCTGAAACCTC[G,A]TTACTTTTAAAATTTATTAGATATA | 2,164,968 | 84 |
| 5463. | ATATATTTAACCTATTAAAAAAaT[G,A]TTAAATATAAATAGGATATATAACA | 2,165,018 | 84 |
| 5464. | GAAGTTTAAAATAATATATTTAAC[C,T]TATTAAAAAAaTGTTAAATATAAAT | 2,165,031 | 84 |
| 5465. | TATTTATCTGACATGATCGACCAC[G,A]TAACTATTTAGTAAATAGGATTGGC | 2,165,086 | 84 |
| 5466. | ATAAATTAATTGTAATGCATCATT[G,A]GTGATTCAGTAATCATTAATGTATA | 2,165,196 | 84 |
| 5467. | AGTAAGTACAATATATTAATTATG[T,C]ACCCTTCTATATTAATAAATTAATT | 2,165,235 | 84 |
| 5468. | AACTTTAAGTTTTCTTATATTTTT[C,A]ATACAAATCATGTAGGATTAGTGTT | 2,165,556 | 84 |
| 5469. | TATTATATTTTATATAAAAAACTT[T,G]AAGTTTTCTTATATTTTTCATACAA | 2,165,575 | 84 |
| 5470. | TAATATTGAATATTTTTAATACTT[T,C]ATATTATATTTTATATAAAAAACTT | 2,165,601 | 84 |
| 5471. | CTTTTTAAAATATAGGAGGTGTAA[T,G]TGAAATCGAACTAAAATCGAAGGAT | 2,165,706 | 84 |
| 5472. | AAGGTTCATTTGACACTTTTTAAA[A,G]TATAGGAGGTGTAATTGAAATCGAA | 2,165,721 | 84 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 5473. | ATTAAAATAGTTTGTTAAATAGAA[A,G]GGTTCATTTGACACTTTTTAAAATA | 2,165,744 | 84 |
| 5474. | TATCATGTCAAGGTCACATGATAC[A,C]ATTTCATTAATAGAAATAGATAGTA | 2,165,801 | 84 |
| 5475. | ACTTTTATATATATTTATATTTTT[A,T]AATATGTGAAAAATTTTATATATAC | 2,165,966 | 84 |
| 5476. | ATAGAACACTTTTATATATATTTA[T,C]ATTTTTAAAATATGTGAAAAATTTTA | 2,165,973 | 84 |
| 5477. | TTTAACCTCATTCAAACTTACTCG[T,C]GTAGCCAAATTAATTCACAATGAAT | 2,166,189 | 84 |
| 5478. | TTGTGGTTAGGTCCTTGATGCAAT[G,A]GATCTTACTTTTTAACCTCATTCAA | 2,166,224 | 84 |
| 5479. | ATACTATATGAGAAAATTGTGACC[T,C]TTAGAAGTTAGGGTTTGTGGTTAGG | 2,166,263 | 84 |
| 5480. | TTTGAATGCTGAAAAGGAATACTA[T,G]ATGAGAAAATTGTGACCTTTAGAAG | 2,166,281 | 84 |
| 5481. | AATTTTATATGAAATGACTATCAA[A,G]AAAGCAATTTTATGGTACTCAGCTA | 2,166,350 | 84 |
| 5482. | TTCAATTATGAAGTATTGGGCT[A,G]TTATAATTTGACCTTTATAAATAGT | 2,166,413 | 84 |
| 5483. | AGGTCTATTTAGATATCCGTATAA[T,C]GATCATGGATTGGGACATCCAGATA | 2,166,478 | 84 |
| 5484. | GCTATATGTCAAATTTTATTTTtTT[T,C]TATTtTTTATATTTTTTAAATAAGA | 2,166,875 | 84 |
| 5485. | CTATCTATATAATAATTATAAAGC[G,A]ATATACGGATATTAGAGATGATATT | 2,166,965 | 84 |
| 5486. | TACGTAAAACATCTCCTCCCTTTG[A,G]AATGGAAATTGATGCATGGACAATG | 2,167,083 | 84 |
| 5487. | GAATTAGTTGGGCAAGGAAGGATG[T,A]CTTGTACATAAATATTTCCAAGAAA | 2,167,238 | 84 |
| 5488. | CCCTGGTGGCTTCTTCCAATCCGT[G,A]CCCTATGCTTCCACCATGGCCACCC | 2,167,883 | 84 |
| 5489. | TCGTAAAGGTTTTCCTTTTTCCTT[A,G]CTGCCTTTACGAGTGGGACTATGAT | 2,168,301 | 84 |
| 5490. | TGTGTATAATTAGCTGAACATCAA[A,C]TACTAGTCAAAAAAAAAaaGCAGC | 2,168,393 | 84 |
| 5491. | AGTTCTTAGCCTTGTACATACTTA[T,C]TCACAACTTGTAACCAAAGACACCAA | 2,168,514 | 84 |
| 5492. | ATCAGGGCTTAGTCAAAAATTTTA[T,A]GTGGGATTTCTAAAGCCTAAAACTG | 2,168,835 | 84 |
| 5493. | AATTTCCTCCGGTTGTTAGTCACA[G,A]ATTGACAGATGCCTCATTTATTGCC | 2,169,188 | 84 |
| 5494. | ATCAACAGTTGAAAATTTTTCCGT[T,G]AATCTTCCCTTATTATGTATTTCTG | 2,169,393 | 84 |
| 5495. | CATGGAACGTGGTCAAACTAGCAT[G,A]CAGAACTTCGGACATTCTGGTGCTG | 2,170,204 | 84 |
| 5496. | ATGACATTAGTTAGGTTGTGGCTT[C,T]TCTTGCAAAACAGCAAACGTGACAT | 2,170,938 | 84 |
| 5497. | GCCCGAACCGTCTTTCTTTCAAAG[A,T]CTCCAATCCTCTCTCTCTCCTCTTC | 2,172,125 | 84 |
| 5498. | TCCCTCCCCTGACGACGTGTCCCT[A,G]TCAGGCGACGTGGTGCTCCACGGAG | 2,172,447 | 84 |
| 5499. | TTTTTTTTtGGTAGAAGTTTGGA[T,A]AACTTATTTAAAAGAAGAAAGTCAT | 2,172,797 | 84 |
| 5500. | GAAAAGATTAATTCTTTACTATAG[C,T]TGTCTTTAAGAAAACAGAAAACACA | 2,172,931 | 84 |
| 5501. | GTCCACCTAATAGTAATTTATTCT[A,T]CCATACATAATTAATCTAGTTCACC | 2,173,099 | 84 |
| 5502. | GAATTGATAAGTCCACCTAATAGT[A,T]CCATACATAATTAATCTAGTTCACC | 2,173,109 | 84 |
| 5503. | TAGATTCTCATCTAGAAAATGTTG[T,A]GCTTTATATCAACGTCATGAAATAT | 2,173,176 | 84 |
| 5504. | ACGTGCGCCTCATGGCTCTATCCA[A,T]GACTTTAATAGGAAAGAAGGCTCTG | 2,173,794 | 84 |
| 5505. | CTCCCACAAGTGCCCAAAAATGGA[C,G]TTATTGGTTGTTTTATTTGTTGGCA | 2,175,171 | 84 |
| 5506. | AGCTGAAGTCTTAGATTATTGCTC[T,C]GAGAGGTGTAGTGATGGAACCGAAA | 2,176,993 | 84 |
| 5507. | ATAGAAAGAGTTAAATGATAGGGA[C,T]ATATTGAAATATCAACAATGCTTTT | 2,177,070 | 84 |
| 5508. | CATATGTATAGAAAGAGTTAAATG[A,G]TAGGGACATATTGAAATATCAACAA | 2,177,077 | 84 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 5509. | CTTCCTTGAAATTAGCTTTATTAT[G,A]ATGGTAACTAATATTTCTGAAATAT | 2,177,202 | 84 |
| 5510. | TCCTATGAACATGCCTATAACAAGG[A,C]TGCCATTTCTAAAAAGGGAAAAAGA | 2,177,356 | 84 |
| 5511. | ATCTTGAAATTATATGACATCGTT[C,T]TGGTGCTCCTATGAACATGCCTATA | 2,177,387 | 84 |
| 5512. | TCTCATAGACTATAAACCAGTGTA[A,G]GATTATATATGATAATCCGGGCCAA | 2,177,436 | 84 |
| 5513. | AACATTTTAGCATGCGGTCCATCA[A,G]CCATGATTTTTTtAATTTTtGATCT | 2,177,841 | 84 |
| 5514. | CAAAAATGAGTGAAATACATAGGA[A,G]TAGTATGGAGTATAATTCATAAAAA | 2,178,055 | 84 |
| 5515. | TTTGTGTTCCTTTGAGCCATCGTC[G,A]TGAGAAAATATTCACAGCAACGGTG | 2,178,148 | 84 |
| 5516. | GGCTGCCAAATGCTGGAAAGACTT[T,A]AAGACCCTTTTACATAAAAGTTTTA | 2,178,253 | 84 |
| 5517. | TTCATCTTTTTCACAAGAAAGATA[C,T]AGGTATGATTACAACCTTTATAAAT | 2,178,911 | 84 |
| 5518. | ATTAATGATATAACAAACTACTCA[T,G]GGATAATAATTCTCAAAAGAAAATA | 2,179,071 | 84 |
| 5519. | TATTAACTAGTATAAATAAATAAT[G,A]AAAAAATTAAAATTTTACGAGAGAT | 2,179,495 | 84 |
| 5520. | GATGATTTAAAAATAAGGTATATA[C,T]CACTTATTTATAATCGCAAGATCGC | 2,179,604 | 84 |
| 5521. | CATTAAAAATTATAGCAAGCATGC[T,A]TCTTGACGGTTACACACCTCTATCT | 2,180,510 | 84 |
| 5522. | TTCATGACAAGCCATTAAAAATTA[T,C]AGCAAGCATGCTTCTTGACGGTTAC | 2,180,522 | 84 |
| 5523. | CGATGTGATGACCATTTCTGATGG[G,A]CACTTGATGGGTCATTAACTTCAA | 2,180,588 | 84 |
| 5524. | AGAAATTCTTGGCAATCCTAAGTC[G,T]TTGAACAAGTAGTCACATTTGTTTT | 2,180,880 | 84 |
| 5525. | ATATCTTTGGCCAAATGGATAGGT[C,T]AGGCCATGAACTAAAATTAACAGGC | 2,181,006 | 84 |
| 5526. | AATTAGAGAGTCAGAATTAGAGAG[C,T]CGACTTTCTTTGAGAGGCAGTCCAA | 2,181,049 | 84 |
| 5527. | CATCCAATCAGAATTAGAGAGTCA[G,A]AATTAGAGAGCCGACTTTCTTTGAG | 2,182,060 | 84 |
| 5528. | TTTATAAGTGGCATCCAATCAGAA[T,A]TAGAGAGTCAGAATTAGAGAGCCGA | 2,182,071 | 84 |
| 5529. | TAGGAGTAATTTAAGAATTAATAA[A,G]AATTATTAATTCTTAGGATGATTTT | 2,182,251 | 84 |
| 5530. | CACTTGCACTCTCGCTCATTATTC[C,T]CACACTGTAGACTAAAAACTCGTCT | 2,182,370 | 84 |
| 5531. | CCACTTGCACTCTCGCTCATTATT[C,T]CCACACTGTAGACTAAAAACTCGTC | 2,182,371 | 84 |
| 5532. | TGATCGCTCATTTGATCACACTCA[G,A]TACCGATGTTCTCTAACAACCACTT | 2,182,415 | 84 |
| 5533. | AAACTACTCACACCACTACAGCAT[T,C]GAGACGATCATTGACGAGTGAGAAA | 2,182,474 | 84 |
| 5534. | CAAAAACTACTCACACCACTACA[G,A]CATTGAGACGATCATTGACGAGTGA | 2,182,478 | 84 |
| 5535. | TTGCTATGGCCACAAACTTAAGGA[C,T]CCAGCCTCTCAAATTTCATAGTACT | 2,182,696 | 84 |
| 5536. | ATTTAGTTTCTCTATCATGTGTCC[T,C]GATAGGATGGAGGTTATGAAAACTC | 2,182,834 | 84 |
| 5537. | TTGGATTGCAACATTTATAATTAG[A,G]TCCTCCTAGCTAACAATTAGCTGAT | 2,183,196 | 84 |
| 5538. | TTCAATCTCAATCCAATTCGAATC[G,A]AATTCGAGTCCAACCTGATCCAGAC | 2,183,375 | 84 |
| 5539. | GGTTTGGGTTCAATCTCAATCCAA[T,G]TCGAATCGAATTCGAGTCCAACCTG | 2,183,383 | 84 |
| 5540. | TCTCTAGGGTGATCGACCAGGAGG[A,G]GGTGGGCATGTGGATTAGGGTGGA | 2,183,791 | 84 |
| 5541. | TCTCCCTTTCTTTCTTTATTTTTC[T,C]CGCTGATCTCTCTCTTTCCTTCTCT | 2,183,836 | 84 |
| 5542. | AGGTACTAGCTCTCTTGTAGATCT[T,C]ACTCCTTCAAGTTTAGATCTAATCT | 2,183,982 | 84 |
| 5543. | AGGCTAAAGTAGATCAAAGCATCC[A,G]AGATCCCCGAGGTACTAGCTCTCTT | 2,184,016 | 84 |
| 5544. | GAAAAATAAAATGAAAGTATGCAT[A,C]TAATTTTAAAATAAAATAATCAAAA | 2,184,188 | 84 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 5545. | CATATGAACCCGTGACTCTGATAC[T,C]ACTATTGAATTTTGAGGTGTCATGC | 2,184,352 | 84 |
| 5546. | TTATGCCAAGACAATCTTATAGCA[T,C]ATCGATATCGAACTAATTAACATAT | 2,184,589 | 84 |
| 5547. | AAATATATCATAAATCTCATACAT[A,G]ATTGTAGATTAAATCTAAAATCGTT | 2,184,682 | 84 |
| 5548. | TCGACTTGATTAACTACAACTATT[A,G]TTTTAATCCTGAGAACTCTTGATCT | 2,184,955 | 84 |
| 5549. | TTAACATATAGATATCAATCGACT[T,C]GATTAACTACAACTATTATTTTAAT | 2,184,973 | 84 |
| 5550. | TTTGGGTCAATCGAGTTAACATAT[A,G]GATATCAATCGACTTGATTAACTAC | 2,184,988 | 84 |
| 5551. | CTTACAATATTTAGTGCCTCTAGC[A,G]TCTTAAATTAAATATTCATCACCAC | 2,185,133 | 84 |
| 5552. | TAATAAAATAATATTAATGATTAC[T,G]TACAATATTTAGTGCCTCTAGGATC | 2,185,156 | 84 |
| 5553. | AAATAGACTAGATAGCATTAAATT[T,C]TTAATAAAATAATATTAATGATTAC | 2,185,182 | 84 |
| 5554. | ACTCTCGATTACCTGTAAAATAGA[C,T]TAGATAGCATTAAATTTTTAATAAA | 2,185,199 | 84 |
| 5555. | TTCACACTGAAATAAGAGCTGATT[A,G]CTTGGTTCACTCAAATCTGAACCAA | 2,185,280 | 84 |
| 5556. | CTTGCTGCGCCCGATGGTGGATGT[G,A]TCTCCTTGAATCCTTCATTTTTCTC | 2,185,801 | 84 |
| 5557. | AACCAAGTTGATCTTCTTGCTGCG[C,T]CCGATGGTGGATGTGTCTCCTTGAA | 2,185,816 | 84 |
| 5558. | CTTTTCATTAATCTTATAAAGAAG[C,T]ATACATAAAAAAAAAAAaTTACGAT | 2,185,878 | 84 |
| 5559. | AATAGTAAATTATTCTAATCTATA[A,G]AAAGTAGTAAATTGCTAGGTTATAG | 2,186,320 | 84 |
| 5560. | ATCTATTTATGAAGTAGAAAATCT[C,T]TAATTATATAAAAATAGTAAATTAT | 2,186,357 | 84 |
| 5561. | ACAGTTAAGAATAAAAGGTAACTA[T,C]GTAATCCAAATAAAAGGCTAAGAAT | 2,186,410 | 84 |
| 5562. | TAACTACTTAACTATGCAAATAAG[G,A]TAATCTCACAGTTAAGAATAAAAGG | 2,186,442 | 84 |
| 5563. | ATAGTAAATCACTAAGAATAATAG[G,A]CAATAATAAATAAGATAACTACTTA | 2,186,482 | 84 |
| 5564. | TTTTAGGATAATAAATTATTCTAA[G,A]CTATAGAAAATAGTAAATCACTAAG | 2,186,516 | 84 |
| 5565. | AAGATCAAGTGATTCTAACTAAAT[A,G]AAAAGTAAATCATACTAAGATTAAA | 2,186,610 | 84 |
| 5566. | ATTAGATATTAGAAGATCAAGTGA[T,A]TCTAACTAAATAAAAAGTAAATCAT | 2,186,622 | 84 |
| 5567. | TTAAGYAGATTTTAAAATTTAATT[G,A]ATTTATTTATATTAGTCAAGTGTTA | 2,186,751 | 84 |
| 5568. | TCTGAAGATTTATATCATCATTCTTG[G,A]TCTCTTCAGGCTCTCCAGGTATGTACA | 2,194,296 | 84 |
| 5569. | TGGCCCTTTTGCCATATCCCACAA[T,A]ACATAGCTTGGTCATTTTTTCTTAA | 2,194,932 | 84 |
| 5570. | TTTTCTTTGAGATAACTCAAAAAA[G,A]TTTTACTAAAATATTCTCCTCTTCA | 2,195,199 | 84 |
| 5571. | AGAAGGAGTCCATTATAAGACTAT[A,G]TCATTTTCTTTGAGATAACTCAAAA | 2,195,227 | 84 |
| 5572. | AGAATCTTATTTAGTAAATAAATC[A,G]TGGTTAGTAGAGCATAACCCTAAG | 2,195,373 | 84 |
| 5573. | GTAGAAATAGATTTAGAGAGAATC[T,C]TATTTAGTAAATAAATCATGGTTAG | 2,195,391 | 84 |
| 5574. | TATCTCATATGATATAGTAGAAAT[A,G]GATTTAGAGAGAATCTTATTTAGTA | 2,195,407 | 84 |
| 5575. | TAGCCTCTAACTTGTCAGCCATTT[G,A]TCTTTTCACATAGGCTGGACATCTC | 2,195,486 | 84 |
| 5576. | TGGACCTAGCCTCTAACTTGTCAG[C,T]CATTTGTCTTTTCACATAGGCTGGA | 2,195,492 | 84 |
| 5577. | AGCAAAAGTAGTATCATATTGATT[C,T]TTTAGGATACCTTATGAAGCAAGCT | 2,195,546 | 84 |
| 5578. | CGTGTCTGACTCACAATTACATTAT[G,A]ATCGTCTGAAAAGCAAAAGTAGTAT | 2,195,582 | 84 |
| 5579. | ATTTTTCTAGAAACATAGCGTGTC[G,A]ACTCACAATTACATTATGATCGTCT | 2,195,600 | 84 |
| 5580. | TAAATTATTTTTCTAGAAACATAG[C,T]GTGTCGACTCACAATTACATTATGA | 2,195,600 | 84 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 5581. | TAGATCCTCTGTAAGCATACCTAA[G,A]TACCTTTCAAGAGGACAGGAGATCC | 2,195,779 | 84 |
| 5582. | ATGATCCTTATCTCCTACGAAGAA[T,C]ATTTCTTCTAGATCCTCTGTAAGCA | 2,195,812 | 84 |
| 5583. | TCTTTTCTTGTAGTGTCTCCATGA[T,C]CCTTATCTCCTACGAAGAATATTTC | 2,195,832 | 84 |
| 5584. | TTATGATGAAAAATAATTTTTATC[G,A]TAAATAATTTATTATTAGCAATAAA | 2,195,958 | 84 |
| 5585. | ATTAACTTTTCATCATAAATACTT[T,C]TATTATTTATGATGAAACTATTTTC | 2,196,129 | 84 |
| 5586. | TATGTCAAAAATTTAATTATTATC[A,G]TCAATACTCATTATTTATGATGTAA | 2,196,571 | 84 |
| 5587. | ATTTATGTCAAAAATTTAATTATT[A,G]TCATCAATACTCATTATTTATGATG | 2,196,574 | 84 |
| 5588. | TCATCGCTAATACTCCATTATTTA[C,T]GACGTAATATTTTTATCACAAATAA | 2,197,001 | 84 |
| 5589. | CAATGAAAATTGATGTTTCATCGC[T,C]AATACTCCATTATTTACGACGTAAT | 2,197,018 | 84 |
| 5590. | ATTGACAATGAAAATTGATGTTTC[A,G]TCGCTAATACTCCATTATTTACGAC | 2,197,023 | 84 |
| 5591. | TATGCACATATTATTTTTAAAAA[T,C]TATCTAATATTTATTTTTATAAATA | 2,197,219 | 84 |
| 5592. | TTGTCTAGGATTGATTTTTGATTT[T,C]CATAATATTTTGGATCCAACCATTC | 2,197,390 | 84 |
| 5593. | GGCCTATTTTACTATTGTCTAGGA[T,C]TGATTTTTGATTTTCATAATATTTT | 2,197,404 | 84 |
| 5594. | GACAAGGAACCAGATCATCAGTTT[C,G]GGATTTTTTAAATTAAAATTTTGAT | 2,197,651 | 84 |
| 5595. | ATGTAAGTATTTTCTAGGCTTCG[A,G]AACCATGAATTAGACAAGGAACCAG | 2,197,688 | 84 |
| 5596. | CTTGCTGTTCAAGAATGTCGGCAA[C,T]AGAAGGTAATTCTTAGACGTTGTTG | 2,197,870 | 84 |
| 5597. | AAGATGGAGATGGATAGAATAAAG[C,T]AATTATAAATATAAAACTCTTTTTC | 2,197,931 | 84 |
| 5598. | TACGAAGATATTTAAAAGTTTCAA[A,G]AAATAATATTAAAGCATACAGCTTG | 2,198,007 | 84 |
| 5599. | GATACGAAGATATTTAAAAGTTTC[A,G]AAAAATAATATTAAAGCATACAGCT | 2,198,009 | 84 |
| 5600. | TTACCTTATCAGCGGACGCGACTG[C,T]GATGGCGACGGTGATCGAGGATGGC | 2,198,575 | 84 |
| 5601. | TCGGTTCACGATTTTAGTATGAAG[C,T]AATTTTATCAAAAATTTTAACTTGA | 2,202,190 | 84 |
| 5602. | CTTTATAAAATAATATACAGTCAT[T,C]TTTGCAGGCATGTATAAGAATATAG | 2,202,359 | 84 |
| 5603. | TTATCAAATTTCGGACATTCAGTT[G,A]CTTATTCATTATCTTTATAAAATAA | 2,202,396 | 84 |
| 5604. | TAATGTCATCTCATTTTTTCAGCT[A,G]TCTTTATGGACATATATAACCTTTG | 2,202,528 | 84 |
| 5605. | GATGGCTAAGTATATTCTCCTCAG[G,A]AAGTCACTACTCATAATGTCATCTC | 2,202,566 | 84 |
| 5606. | TCTTTCCATACTAAAGAGTCGACC[A,G]GATGGCTAAGTATATTCTCCTCAGG | 2,202,591 | 84 |
| 5607. | GACCAAGTCGAGATATTGTGGGAT[C,T]ACTCGCAAAGTATGAATGCTTTGCA | 2,202,647 | 84 |
| 5608. | AGGTGACACATTATATACAACTAG[T,C]ATCACAGGCCACATATTATAAAAGG | 2,202,736 | 84 |
| 5609. | TTCATTACCTGGTGCTTTCGGATC[C,T]GGAATCAACTGTGACATAAAAATAA | 2,202,808 | 84 |
| 5610. | TATACATCAATTTCATTACCTGGT[G,A]CTTTCGGATCCGGAATCAACTGTGA | 2,202,819 | 84 |
| 5611. | TATATACATCAATTTCATTACCTG[G,A]TGCTTTCGGATCCGGAATCAACTGT | 2,202,821 | 84 |
| 5612. | GTTGTATATATACATCAATTTCAT[T,A]ACCTGGTGCTTTCGGATCCGGAATC | 2,202,827 | 84 |
| 5613. | GACCTATGAAATATATTTTCTGTC[T,C]GTGCTTTAAATATAAAGAGGATGCA | 2,203,058 | 84 |
| 5614. | TCCTTAGGTGGCGAACATCGGTCG[G,A]ACTTACCATCAAAATATTGGTTATA | 2,203,149 | 84 |
| 5615. | ATTAGACATTTTCAATGACTTCAA[A,G]TTGTTCTAAAATTTTTGCTCCATTT | 2,203,202 | 84 |
| 5616. | TTTGTCCAATTCAGCTCAGCTTCA[G,A]TATGCTTCCACTTGCGAGTACCCGA | 2,203,263 | 84 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 5617. | TAGTTCGAAAAAGATGCTTCACTT[T,C]GTCCAATTCAGCTCAGCTTCAGTAT | 2,203,285 | 84 |
| 5618. | ACCGATGATATTATCATAAATATT[T,C]TTTTCAATGTGTATTACATCGAGAT | 2,203,366 | 84 |
| 5619. | TTTTTCTAGATGTTCAATACAGTA[C,T]CGATGATATTATCATAAATATTTTT | 2,203,389 | 84 |
| 5620. | GCAACTTCGATCGGATTCTCATTT[C,T]CTGCAAATCAAGATGAGCTTTTGTA | 2,203,450 | 84 |
| 5621. | GATTTTAAACCATCCACAGAAATT[T,C]TTCTTTTCCTCACCAAACAGTGAAT | 2,203,546 | 84 |
| 5622. | TAATTTTTGACAACACAGTTCTCG[G,A]AAGAACACTCCCAGCTCAATCAATG | 2,203,753 | 84 |
| 5623. | TTCTAACTTACAAAGAATGAGTAC[G,A]ATATCCTTCTCTAATTTTTCAAGTA | 2,203,813 | 84 |
| 5624. | ATCCAACGATAATGTACCGGTCCG[A,G]CCAAAAGTGCTTTCTTTGGAAGATA | 2,203,912 | 84 |
| 5625. | GGATACATCCAACGATAATGTACC[G,A]GTCCGACCAAAAGTGCTTTCTTTGG | 2,203,918 | 84 |
| 5626. | GGCACGGTCTGTCTCGTCCGATTC[T,A]CCGTATTTTTGGCACATCTCTCTG | 2,206,064 | 84 |
| 5627. | AAAaTTAAAAATTACCTACCATGT[A,G]CTCCATGTGACGAGCGAACGATCTC | 2,206,129 | 84 |
| 5628. | CAATTTGAGAATTAATTAAAAAAa[T,A]TTTAAATAACTAAAAATTATATGCT | 2,206,184 | 84 |
| 5629. | CATCTGGATCTGAAGCTGCTGATA[T,C]TTATCGACGCGTGCAGCCAACTCCT | 2,206,399 | 84 |
| 5630. | CATCTGGATCTGAAGCTGCTGATA[T,C]TTATCGACGCGTGCAGCCAACTCCT | 2,206,677 | 84 |
| 5631. | CTATCCACTCTATCATCTGGATCT[G,A]AAGCTGCTGATATTTATCGACGCGT | 2,206,690 | 84 |
| 5632. | GACATCTAGAGAACGAGCTGGAGA[C,T]GGAGAGCACTTGACGGAGCTCGAAC | 2,206,785 | 84 |
| 5633. | ATATTAAATTAAAATTATAAAAAa[T,A]TTAAAaTAAAAAaTATATCAATAAG | 2,206,847 | 84 |
| 5634. | TATATATTTATTAAAAAATTAAAT[C,T]ATGTTAGTAAAATATATTTGACGAT | 2,207,064 | 84 |
| 5635. | TAGCGATGAAAATATTTTCATCGC[C,T]ATTAATTCTAAAGTTTTAGCGACTA | 2,207,304 | 84 |
| 5636. | ATATTTATGATGAATTATACCATC[A,G]CTAATAAATAAAAAaTTAATAGCGA | 2,207,348 | 84 |
| 5637. | CATAATTTTCGTCACTAATATTTC[G,A]TCACCAATAATCGCATCGTTGATAA | 2,207,493 | 84 |
| 5638. | TACAACAAAATAGGTTATTAGCGA[T,C]GAAAAATTTTCATCGCTAATAATCG | 2,207,570 | 84 |
| 5639. | TTCACCTCGAGCCTAGCTTTATAG[G,A]TCTCTACTTTACCATCTATACCTAT | 2,207,791 | 84 |
| 5640. | GATCTCCATCACTAGATGTGAAAT[T,C]CTTAGGCTATTCCATATAGAAATCT | 2,208,000 | 84 |
| 5641. | CTATATATAAATCTTTACAGCTTG[C,T]AGACTTTATGATCTCCATCACTAGA | 2,208,034 | 84 |
| 5642. | GAAGCTTGTTTTAATCTATATATA[A,G]ATCTTTACAGCTTGCAGACTTTATG | 2,208,049 | 84 |
| 5643. | TCGTTGAAATGAATATTCTAACTT[T,C]GAGAAGCTTGTTTTAATCTATATAT | 2,208,076 | 84 |
| 5644. | TGTCATCCACGTACAGTACGAAGA[A,C]TGTGACAGCACTCCCACTGATCTTC | 2,208,180 | 84 |
| 5645. | AAAAATGTAATTCCCAATAAGGAG[G,A]ATGTCATCCACGTACAGTACGAAGA | 2,208,206 | 84 |
| 5646. | CAATCATCTTTTGATCAAAAATGT[A,C]ATTCCCAATAAGGAGGATGTCATCC | 2,208,222 | 84 |
| 5647. | ACTTCCCCTATGTACATTTTCTAT[G,A]AAAAACCAAGCATCCTTTTGGATCT | 2,208,341 | 84 |
| 5648. | ATCCAGTACTCTTCGTCCAGATTC[G,A]ACTAATAACTGCTCATGACACTCAC | 2,208,581 | 84 |
| 5649. | CACAGCTATCCAGTACTCTTCGTC[C,T]AGATTCGACTAATAACTGCTCATGA | 2,208,588 | 84 |
| 5650. | CTGAATTAATATATCCTTCGAACC[A,G]CAGCTCTGATCCTCCGTCAAAGATT | 2,208,683 | 84 |
| 5651. | CACCATTGCATACAAACACACAAT[T,C]TGATATAGATCTTCTATCATCAAAA | 2,208,746 | 84 |
| 5652. | TTGGAACTCTTCCACCTGGTAGCT[T,C]CACCATTGCATACAAACACACAATT | 2,208,771 | 84 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 5653. | TATCATTACACTAAGTTCTGCGAT[G,A]AATTTTTTATACCAGAAAGCTTCCT | 2,208,883 | 84 |
| 5654. | TAAAGTAATGGCATCCAATATCAT[T,G]ACACTAAGTTCTGCGATGAATTTTT | 2,208,901 | 84 |
| 5655. | AGTGCTATGGTGTCATTGTTGTCG[T,C]AGTATAAAGTAATGGCATCCAATAT | 2,208,930 | 84 |
| 5656. | TAGACTCTTTAGTGAGTGCTATGG[T,C]GTCATTGTTGTCGTAGTATAAAGTA | 2,208,944 | 84 |
| 5657. | TTTGTATATGACTCCATAGGTTCT[A,G]TTCTGTCTGGTAGTGAGATATTGTC | 2,216,699 | 84 |
| 5658. | GATGCTGAATCGACGAAGAAGGTA[G,A]TGTGGGAGAAGTTTCTGTCATGACT | 2,216,699 | 84 |
| 5659. | CTTGGATTCATAAATTCAATTTCT[T,G]TCATCATTGTACATCAGGTTTCTGA | 2,216,699 | 84 |
| 5660. | AGTTGAGGAAGCCTTGGGTAACGT[G,A]CTTCATCTCTGCTTGAGCCACTTGT | 2,216,699 | 84 |
| 5661. | TGGGTAACGTGCTTCATCTCTGCT[T,C]GAGCCACTTGTATAAAAATCATATA | 2,216,699 | 84 |
| 5662. | ATATGATTGTTACAGTGTCAGGCT[T,G]GCCAGCCCTGGCTTTGGATTGGGCC | 2,216,699 | 84 |
| 5663. | TTGGAACTCTTCCACCTGGTAGCT[T,C]CACCATTGCATACAAACACACAATT | 2,216,699 | 84 |
| 5664. | CACCATTGCATACAAACACACAAT[T,C]TGATATAGATCTTCTATCATCAAAA | 2,216,699 | 84 |
| 5665. | CACAGCTATCCAGTACTCTTCGTC[C,T]AGATTCGACTAATAACTGCTCATGA | 2,216,699 | 84 |
| 5666. | ATCCAGTACTCTTCGTCCAGATTC[G,A]ACTAATAACTGCTCATGACACTCAC | 2,216,699 | 84 |
| 5667. | ACTTCCCCTATGTACATTTTCTAT[G,A]AAAAACCAAGCATCCTTTTGGATCT | 2,216,699 | 84 |
| 5668. | CAATCATCTTTTGATCAAAAATGT[A,C]ATTCCCAATAAGGAGGATGTCATCC | 2,216,699 | 84 |
| 5669. | AAAAATGTAATTCCCAATAAGGAG[G,A]ATGTCATCCACGTACAGTACGAAGA | 2,216,699 | 84 |
| 5670. | TGTCATCCACGTACAGTACGAAGA[A,C]TGTGACAGCACTCCCACTGATCTTC | 2,216,699 | 84 |
| 5671. | ATCATTTTGTCTGCAATATGTTTG[A,G]CAGAAGAACAAATCATTTGCAGGCC | 2,216,699 | 84 |
| 5672. | AAGGCGCAAATGCGAGAGTAATTA[G,T]AATCTACTGGGGCTATTTATATATA | 2,216,699 | 84 |
| 5673. | GAGGTACAGAGCCACCATTTGTTC[C,T]GGAAGCTCTCTACCATTGCAGTGCA | 2,216,699 | 84 |
| 5674. | TTCCGCCTTCGCCACATTCGAATT[C,T]CATCGCAAATTCGCCTCCAAGTCCA | 2,216,699 | 84 |
| 5675. | AGGTCCTCCTAGCTAACAATTAGC[T,C]GATCCAATGCTTGTAACTTTTACAA | 2,216,818 | 84 |
| 5676. | ATTGAATTGCAACATTTGCAATTA[G,C]GTCCTCCTAGCTAACAATTAGCTGA | 2,216,841 | 84 |
| 5677. | AGAACTTGGTTTTCTAATTTGATC[T,C]CATCAAATTGAATTGCAACATTTGC | 2,216,872 | 84 |
| 5678. | AGGTCAAGCCCAAACTAATTAGGC[T,C]TGATTTAATTAATTAGAACTTGGTT | 2,216,911 | 84 |
| 5679. | GGCCGACTAGATGGAGGTGGGGTG[C,T]GTGGATTAGGGTGGAAGCGACGAGA | 2,217,436 | 84 |
| 5680. | TAGAAGAAGACTCGCGGATCAACA[A,G]GGCTGAAGTAGATCGAAGTGTCCGA | 2,217,570 | 84 |
| 5681. | CCGACCTCTACACGTATCCACACA[A,G]GGCTGAAGTAGATCGAAGTGTCCGA | 2,217,693 | 84 |
| 5682. | AGGTTCCGTTGAAACCGCACATAC[A,G]TCCGACCTCTACACGTATCCACACA | 2,217,719 | 84 |
| 5683. | AGTTCATATGATGAAAAACAAGAT[G,A]AAAACATGCATCTGATTTCAAAATA | 2,217,853 | 84 |
| 5684. | CTAGTTCATATGATGAAAAACAAG[A,G]TGAAAACATGCATCTGATTTCAAAA | 2,217,855 | 84 |
| 5685. | GAGTGAGACTTCCGCCAAATGAGA[T,A]AAATTTGCTTTTCCATATTATAAGT | 2,218,048 | 84 |
| 5686. | ATCCAATTTCTTGATGACCCAGGA[C,G]GAAAATTTATATAGGGACATGAAGC | 2,218,131 | 84 |
| 5687. | CGCCAAAATGAAACATTTAAGCCA[C,T]TACCAACCGTATATTTAGTTTTGTT | 2,218,487 | 84 |
| 5688. | TTTTACCACGGCAACTATTGAATA[T,G]ATTTGGAAAAGAATTTTCAGTGGG | 2,218,558 | 84 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 5689. | TGAAGACTTGGGTCTCCATGATTT[C,T]AGTATTTGTGCTTAACATCCTTTGG | 2,218,558 | 84 |
| 5690. | GAAGACTTGGGTCTCCATGATTTC[C,G]GTATTTGTGCTTAACATCCTTTGGA | 2,218,558 | 84 |
| 5691. | ATCTGAGAATGGAGAGAAGACC[C,A]GCTTTTTCGTGCTGCACTAATGGAG | 2,218,674 | 84 |
| 5692. | ACATCTGAGAGAATGGAGAGAAGA[C,T]CCGCTTTTTCGTGCTGCACTAATGG | 2,218,676 | 84 |
| 5693. | CCAATCTTTATTAATAAAGAGCTA[C,T]ACAAGAGTAGGATACAGATAAGCTT | 2,219,472 | 84 |
| 5694. | AGTTAGGCTTGATCAGAAGAACAC[G,A]AGATAGGTGAAGGGGAAGAAAAATT | 2,219,726 | 84 |
| 5695. | ACAATACTGATTCCTGGAGATACT[C,T]ATAGTTAGGCTTGATCAGAAGAACA | 2,219,753 | 84 |
| 5696. | CTACAAAAATACTAACACAACTAC[A,C]AATGCAAAGACAACCTTCTTCCTTG | 2,219,870 | 84 |
| 5697. | ACAATACTGATTCCTGGAGATACT[C,T]ATAGTTAGGCTTGATCAGAAGAACA | 2,219,870 | 84 |
| 5698. | AGTTAGGCTTGATCAGAAGAACAC[G,A]AGATAGGTGAAGGGGAAGAAAAATT | 2,219,870 | 84 |
| 5699. | TAGGAAGAAAACTACAAAAATACT[A,T]ACACAACTACAAATGCAAAGACAAC | 2,219,881 | 84 |
| 5700. | GCTGGCAATGTGCACAGGCTACAC[A,T]ACACAACTACAAATGCAAAGACAAC | 2,20,085 | 84 |
| 5701. | ATTCCTCAATGCTGGCAATGTGCA[C,T]AGGCTACACAATTCTGTCAGGTTGG | 2,220,095 | 84 |
| 5702. | TTGTTAGTTGGCTCTCAAGCTGCT[G,A]CTATTCCATTGCCTTCAACTTTGCA | 2,220,200 | 84 |
| 5703. | CTTATTCAGTTGTATTAAATACAA[T,C]TTATTCATGCTGTATAATTTAACTT | 2,220,200 | 84 |
| 5704. | TAGGAAGAAAACTACAAAAATACT[A,T]ACACAACTACAAATGCAAAGACAAC | 2,220,200 | 84 |
| 5705. | GATTCGAGTGGTGCGACGCCAGAG[A,C]TCTTGGGTTGCCATCTCAGGTCTTG | 2,223,894 | 84 |
| 5706. | AGAATGTAAGATAACAGTTCACAG[C,A]AAGATTTACCGCAAAATCATCTAAT | 2,224,178 | 84 |
| 5707. | TTGTCAGATACATAGAGAAGTTCA[G,A]AACAACTAAAAACTAATTGTACAAT | 2,224,681 | 84 |
| 5708. | AGAAAGGGAAAAGTTATCTGGATT[G,A]AGTAGATATACATTTTGAACTTTGA | 2,226,007 | 84 |
| 5709. | CACTTGAATCTAGGAGGGAGATCA[G,T]TTTATTATTGGATTACTTCTTCCCC | 2,226,133 | 84 |
| 5710. | CCTCTGATATGTTTCAAAGCCAAC[G,A]AAACCCTTTACATGTTACCACACTT | 2,226,573 | 84 |
| 5711. | AAAAAAATCTTAAATTGAATCAAT[C,A]GAAAAGCATAGTTTTACCATAGCCG | 2,226,706 | 84 |
| 5712. | AAGAAATAATAGTAAGCAAATGAA[A,G]GTTATCAATTGCTGGATTAATTTTC | 2,226,893 | 84 |
| 5713. | ATTTTAGACAGGAACTGGTACAAT[G,T]CTAAAGTTACAATTCTAAGTTTCAC | 2,226,893 | 84 |
| 5714. | CACTTGAATCTAGGAGGGAGATCA[G,T]TTTATTATTGGATTACTTCTTCCCC | 2,226,893 | 84 |
| 5715. | AGAATGTAAGATAACAGTTCACAG[A,C]AAGATTTACCGCAAAATCATCTAAT | 2,226,893 | 84 |
| 5716. | CAAATTTCATATCCTTTTTCTCTA[A,T]GAGGTCCATTTTATGCCATGGTTGT | 2,226,893 | 84 |
| 5717. | GCTTGCTCGGACACACTTTAATTC[C,G]CAAATATTACTCATGTTGTtTTTTT | 2,227,219 | 84 |
| 5718. | AATATTAGGGGTTAGTTCTATCAA[T,C]CCTTATTCGTTGAGCCTTCCCATTA | 2,227,326 | 84 |
| 5719. | TTTAAAACCTTGGTCCTAAATATT[A,C]GGGGTTAGTTCTATCAATCCTTATT | 2,227,344 | 84 |
| 5720. | GAAACTCAAAAACTTGAAGATAAC[T,A]ATTAAAACCGTTGAAACGGCTGAAA | 2,227,431 | 84 |
| 5721. | TTATTTTGTAAATTTATCGGCTG[T,G]TTTCCCGAAACTCAAAAACTTGAAG | 2,227,462 | 84 |
| 5722. | TTTATTTTTCTCTTATTTTGTAAA[T,A]ATTAAAACCGTTGAAACGGCTGAAA | 2,227,474 | 84 |
| 5723. | GCATCAAAAGAATCTCACAAAAAC[C,T]GTGGATTCCTGTCCTCTTTAGTCCT | 2,227,553 | 84 |
| 5724. | CTATGAAGAGACTGTAAAGAAGTA[T,C]GCCAAGCTATGAAACATATACTTGC | 2,227,777 | 84 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 5725. | ATCCTTCAACCACAGGGAGAAAAG[C,T]ACTTCTGTCAACATCTAGGGTTACT | 2,227,865 | 84 |
| 5726. | GCATCAAAAGAATCTCACAAAAAC[C,T]GTGGATTCCTGTCCTCTTTAGTCCT | 2,227,865 | 84 |
| 5727. | GAAACTCAAAAACTTGAAGATAAC[T,A]ATTAAAACCGTTGAAACGGCTGAAA | 2,228,720 | 84 |
| 5728. | TCTCCACTAAATTTTTCACCTCAT[C,T]ACAAAGCTGTTATGAAGTTGGCCTT | 2,229,240 | 84 |
| 5729. | TCTTCTCGATTCCTTCGTAACATT[T,A]GTTGTTGACATAGAAGATGGTGCTA | 2,229,248 | 84 |
| 5730. | TAACATTATCTTCTCGATTCCTTC[G,A]TAACATTTGTTGTTGACATAGAAGA | 2,229,319 | 84 |
| 5731. | CACCTTACCAATTAAAATCCTCAA[C,T]CTCCATTAAAACCCTCTCCACCAAC | 2,230,789 | 84 |
| 5732. | ACCCAACAACCATGCACAACATAC[C,A]ATCATTATGTGTTTGTTCTACAAAA | 2,230,822 | 84 |
| 5733. | TACCCGGTCTTCCCTTTTACCAAC[G,A]CAACCCAAACCCAACAACCATGCAC | 2,230,969 | 84 |
| 5734. | AATCCATCATTCAAACTAAAACAA[T,C]GCACCCAGGTTGCTCGGAAATTATA | 2,230,973 | 84 |
| 5735. | TGCGAATCCATCATTCAAACTAAA[A,C]CAATGCACCCAGGTTGCTCGGAAAT | 2,231,217 | 84 |
| 5736. | GCCAGCATGAAGTAGGAAAACAAA[T,C]CTAGCCATGTCTTGGAAGAAAATTC | 2,231,248 | 84 |
| 5737. | AAGACAAATAGGTCGGCCAGAAAC[C,A]ACTTTAGCCAGCATGAAGTAGGAAA | 2,231,261 | 84 |
| 5738. | ATAGGAAGGAACCAAGACAAATAG[G,A]TCGGCCAGAAACCACTTTAGCCAGC | 2,231,574 | 84 |
| 5739. | AAGGAaAAAAAAAaTAGTCCTCCT[T,G]GTCTTACCTTTCTCTGATTCAAAAG | 2,231,574 | 84 |
| 5740. | AAGACAAATAGGTCGGCCAGAAAC[C,A]ACTTTAGCCAGCATGAAGTAGGAAA | 2,231,574 | 84 |
| 5741. | TGCGAATCCATCATTCAAACTAAA[A,C]CAATGCACCCAGGTTGCTCGGAAAT | 2,231,574 | 84 |
| 5742. | AATCCATCATTCAAACTAAAACAA[T,C]GCACCCAGGTTGCTCGGAAATTATA | 2,231,574 | 84 |
| 5743. | ACCCAACAACCATGCACAACATAC[C,A]ATCATTATGTGTTTGTTCTACAAAA | 2,231,574 | 84 |
| 5744. | TGATCTTTGTCTGTTATTTTGATG[G,A]CAATGCATTTGTTTTGTGGTCTGTT | 2,231,574 | 84 |
| 5745. | CACCTTACCAATTAAAATCCTCAA[C,T]CTCCATTAAAACCCTCTCCACCAAC | 2,231,574 | 84 |
| 5746. | TCACCAAAACATGCTGCCAGGTAC[A,G]ATTCTTCTGGATAATCCGTCCTCTC | 2,232,075 | 84 |
| 5747. | TTCGTGTACGAGCTCGTCTCGCCA[A,G]AAAAGGTTACGGGAAGGCTCAAGGT | 2,232,124 | 84 |
| 5748. | TGCTATCGGTTTCGTGTACGAGCT[C,T]GTCTCGCCAAAAAAGGTTACGGGAA | 2,232,134 | 84 |
| 5749. | GAACATCATCTCCGTCTCCAGCGA[C,T]GATGACAGCGTCCATCGACCGAACT | 2,232,189 | 84 |
| 5750. | CTAGAAGAGAAGAGGTAGCTGGGG[G,A]CTAGCTCTGCTTTGAAGCCCAAACC | 2,232,322 | 84 |
| 5751. | CAGCAACCATGTGGGCATGCGTTA[G,A]CTGGCTTTTTTAATGGTTTAGGTAG | 2,232,417 | 84 |
| 5752. | GGTCAGCCAGTGGACTTCACACCA[G,A]CAACCATGTGGGCATGCGTTAGCTG | 2,232,439 | 84 |
| 5753. | AAGGTGGCCTTCCCACCCCCACCA[C,T]ATACCATTATTCCATTCAACTCTCC | 2,232,638 | 84 |
| 5754. | GCTTTATTGGGGACCGGATGAAGT[C,T]ATACCATTATTCCATTCAACTCTCC | 2,232,968 | 84 |
| 5755. | GAAGATCTTCTCATCTTAAGGCCA[T,A]TGCTTCAGGTGCATACCAAATCTTA | 2,232,968 | 84 |
| 5756. | GGTCAGCCAGTGGACTTCACACCA[G,A]CAACCATGTGGGCATGCGTTAGCTG | 2,232,968 | 84 |
| 5757. | CAGCAACCATGTGGGCATGCGTTA[G,A]CTGGCTTTTTTAATGGTTTAGGTAG | 2,232,968 | 84 |
| 5758. | CTAGAAGAGAAGAGGTAGCTGGGG[G,A]CTAGCTCTGCTTTGAAGCCCAAACC | 2,232,968 | 84 |
| 5759. | TCACCAAAACATGCTGCCAGGTAC[A,G]ATTCTTCTGGATAATCCGTCCTCTC | 2,232,968 | 84 |
| 5760. | TAGCACCCCAAGCTTGAAGCAAAT[T,C]GCTGTCTAGACTGCAGAGAAGAACA | 2,241,530 | 84 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 5761. | GTAGAAGCATAATTTGTTTGTGGC[T,C]GACCAAGCCTCAAAAGGAGTAATAG | 2,241,530 | 84 |
| 5762. | CAGGCTCTTTTTTCTCTCATTTCT[A,T]TGTTCTTCCCTAGACTTTCTGAAAG | 2,241,530 | 84 |
| 5763. | GGTTAATCCTCAGGTTATTTTTAG[A,T]ATTAAACCAGAAATTCTTCCATGCA | 2,241,530 | 84 |
| 5764. | ATGCAATTTGTGATCTATATATGC[G,A]TATAAAGTAGCATCAGTGGTAGTGT | 2,241,530 | 84 |
| 5765. | CTACTACTTTGTACCTTAATCGCC[G,A]TGCTCCTAAACTATAAACAAGAACA | 2,242,318 | 84 |
| 5766. | TACCTCCATATAAGTACCCAAAAT[C,T]TTTTCAACAAATCATCCATGATAAA | 2,242,489 | 84 |
| 5767. | CAGTTGAAAGGTATTATTTGAGTT[T,C]CTTACCTCCATATAAGTACCCAAAA | 2,242,516 | 84 |
| 5768. | TTTTCGTGTTTAAAATTTCAAATT[T,C]ATATAGATCCATTCATAAATATTAT | 2,242,655 | 84 |
| 5769. | CAATCCTAAATTTTTTAAGTAAAT[A,C]ACTAATATGAGATAAAATACATGCT | 2,242,723 | 84 |
| 5770. | ATTTGAATACCACGTTCAAAAAAA[C,T]TAATCAGAAGATATTATTCAGATTT | 2,242,788 | 84 |
| 5771. | ATTAAAAAAAaTCATCAAAAAAAa[C,T]CTTTGTGGGTATCTATAGTCCAAA | 2,242,869 | 84 |
| 5772. | TAGTTGATTTGAATAAATTTGGAT[C,T]CTTAGCTTGATGTGAACGTCAGGAC | 2,243,768 | 84 |
| 5773. | TTTGTCATGGAATTTATGATACTT[T,A]TAGTTGATTTGAATAAATTTGGATC | 2,243,793 | 84 |
| 5774. | ATCAGAGAGGATTTAACATATAGC[A,C]TATATGGACTAGGGATACTATAACA | 2,243,880 | 84 |
| 5775. | TTGAAATGATATCAGAGAGGATTT[A,G]ACATATAGCATATATGGACTAGGGA | 2,243,890 | 84 |
| 5776. | CAATTTTCCACATTAATTAATCTT[C,T]AATACAATTTGTGAATCCCTTTTGT | 2,244,671 | 84 |
| 5777. | CTGACGGTGCATCATACCGTACGC[G,T]AAGATTCCAGAGGGTGAAAAATTAG | 2,245,411 | 84 |
| 5778. | CTACTCAGCCTTTAAGACCACACA[A,G]GGACATCTATTTGCTCGTAAGAGGG | 2,245,562 | 84 |
| 5779. | ATTTCTTCCCTCTTCCCATCTCTC[G,A]CTTCCTTGCTACTCTCTCTCTTTCT | 2,245,616 | 84 |
| 5780. | CTACTCAGCCTTTAAGACCACACA[A,G]GGACATCTATTTGCTCGTAAGAGGG | 2,245,616 | 84 |
| 5781. | GCTCTTCTTCTTGAAGCCAAGAAA[G,T]CCGAGCAAACATTTCTTCCCTCTTC | 2,245,651 | 84 |
| 5782. | TGGACCAACAATGCGGGAAGAGC[T,A]ACTGGCGATGGGAAAATGGACTATG | 2,245,855 | 84 |
| 5783. | GGTGGACTGAGTTACATAATGAAA[A,T]CATGGCATAGGTGGACCAACAATGC | 2,245,891 | 84 |
| 5784. | GCAAGCTGAAAAATTTAGTGGCTG[T,G]GGTGGTGGAGTGCGATGGTAGAGTT | 2,246,737 | 84 |
| 5785. | AAGACAGCCTTCTTTCGTACTAA[C,A]ATGTCCTCTGCCCTTCTGTGTTGTA | 2,247,093 | 84 |
| 5786. | AAAAGTTTGGTATGGTAATGATGG[C,T]GGTTTGTGAGTGCACTCCAAGTAAT | 2,247,168 | 84 |
| 5787. | TTTTAATGAGAAAAATATTTTTTT[T,C]tCTTTATGATTCGTAGAAGAAAAAT | 2,247,284 | 84 |
| 5788. | AAAAGTTTGGTATGGTAATGATGG[C,T]GGTTTGTGAGTGCACTCCAAGTAAT | 2,24,284 | 84 |
| 5789. | ATAGGATGTCAGAAAAAAaGAAGA[G,A]ATATTTTTtATTTAAAAATTTTAT | 2,247,338 | 84 |
| 5790. | CTCAAATTATAATTTTCTGTATAA[A,G]ATATCATAATTTTTTCATAGGATGT | 2,247,379 | 84 |
| 5791. | ATAGGATGTCAGAAAAAAaGAaGA[G,A]ATATTTTTTATTtAAAAATTTTAT | 2,247,379 | 84 |
| 5792. | CCTACGCTCAAATTATAATTTTCT[G,A]TATAAAATATCATAATTTTTTCATA | 2,247,385 | 84 |
| 5793. | TTTtCATTTAAAATTTTGAATGAT[A,G]AAAATATTCTTCTTCTTCTGAAAAA | 2,247,466 | 84 |
| 5794. | CCTACGCTCAAATTATAATTTTCT[G,A]TATAAAATATCATAATTTTTTCATA | 2,247,466 | 84 |
| 5795. | GTCGTCAATTTTATTTTtCATTT[A,G]AAATTTTGAATGATAAAAATATTCT | 2,247,481 | 84 |
| 5796. | CTCTATCTGATTGGGTCATATAGT[T,C]ACTGTTTTTCGATATGTATTTAATG | 2,247,530 | 84 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 5797. | GAGATTCTTTGTACAACGCATGTG[G,T]TGTAGGAAAAATATACCACTCTATC | 2,247,573 | 84 |
| 5798. | CTAGGGATTTAATTAGATATTGGG[G,A]TGTAGGAAAAATATACCACTCTATC | 2,247,603 | 84 |
| 5799. | CTTCCAGTCTGCCAGACCCACTAG[G,A]GATTTAATTAGATATTGGGGTGAAA | 2,247,623 | 84 |
| 5800. | TTAGAGAAAAGATCAATCACTTTG[T,A]GACCAAGGGGCTCCCCTAGTTATCA | 2,247,749 | 84 |
| 5801. | CTGAGGTTTGAATCTGAAATCTCT[A,G]TTGAATTTTCTTCTCTTTTGGAGGG | 2,249,204 | 84 |
| 5802. | TCTGAGGTTTGAATCTGAAATCTC[T,C]ATTGAATTTTCTTCTCTTTTGGAGG | 2,249,205 | 84 |
| 5803. | CGAAAGATTCCCAGCAAGCCGTAC[A,T]TCAATACCTCATTTTTCCAATCTGT | 2,249,278 | 84 |
| 5804. | TTTTAAAGTCTCCATGTGCTTGCA[A,C]TTGGATATTAATTCATAGGTAGGAA | 2,249,837 | 84 |
| 5805. | TGGCATCCAACACGTGAAATGTCC[C,A]CCTAATTTCGGAAGACCTTTGCATC | 2,249,895 | 84 |
| 5806. | GGAGGATGGAATGAATCTAATACC[T,C]CCCTCTGTCTGTATATATAGGGGAA | 2,250,070 | 84 |
| 5807. | GACCATTGTAACCGCCTCAAGAGC[G,T]TGAGTCGTGGTTTCTGGGCCTTGAT | 2,250,398 | 84 |
| 5808. | ACATCATGTAACTTCACAAAGAAA[A,G]CGGGAAAGAAAAATGATACATGAAT | 2,251,125 | 84 |
| 5809. | CTTGTCCATTTTGTGGGACATGAA[T,C]ATAAAAAAACTATATGCATGCTATG | 2,251,727 | 84 |
| 5810. | AAGCCAAGGATCCACTTAAGTTTA[T,C]TAACTCTGTAGAGCAAGATTGGAAA | 2,251,839 | 84 |
| 5811. | CTTGCCCCCAATCACATCCCTCTT[G,C]TTAGCAATCAGAGGTTATTAAAAAA | 2,251,996 | 84 |
| 5812. | TAATAGTAAAAGGATATTGTGTGC[T,G]ACGTCTTGCCCCCAATCACATCCCT | 2,252,025 | 84 |
| 5813. | TCGGACAACTAGCATTCCATGGAT[G,A]ATTGTTAGGGGAACAATCTATAGA | 2,252,137 | 84 |
| 5814. | TAATAGTAAAAGGATATTGTGTGC[T,G]ACGTCTTGCCCCCAATCACATCCCT | 2,252,137 | 84 |
| 5815. | CTTGCCCCCAATCACATCCCTCTT[G,C]TTAGCAATCAGAGGTTATTAAAAAA | 2,252,137 | 84 |
| 5816. | AAGCCAAGGATCCACTTAAGTTTA[T,C]TAACTCTGTAGAGCAAGATTGGAAA | 2,252,137 | 84 |
| 5817. | CTTGTCCATTTTGTGGGACATGAA[T,C]ATAAAAAAaCTATATGCATGCTATG | 2,252,137 | 84 |
| 5818. | ACATCATGTAACTTCACAAAGAAA[A,G]CGGGAAAGAAAAATGATACATGAAT | 2,252,137 | 84 |
| 5819. | GACCATTGTAACCGCCTCAAGAGC[G,T]TGAGTCGTGGTTTCTGGGCCTTGAT | 2,252,137 | 84 |
| 5820. | TGCTAGCATTGGTCGTTGTACCCT[T,C]TGCTGCTGCCATTGTAAAACTAGTG | 2,252,137 | 84 |
| 5821. | TTTTAAAGTCTCCATGTGCTTGCA[A,C]TTGGATATTAATTCATAGGTAGGAA | 2,252,137 | 84 |
| 5822. | CGAAAGATTCCCAGCAAGCCGTAC[A,T]TCAATACCTCATTTTTCCAATCTGT | 2,252,137 | 84 |
| 5823. | TCTGAGGTTTGAATCTGAAATCTC[T,C]ATTGAATTTTCTTCTCTTTTGGAGG | 2,252,137 | 84 |
| 5824. | CTGAGGTTTGAATCTGAAATCTCT[A,G]TTGAATTTTCTTCTCTTTTGGAGGG | 2,252,137 | 84 |
| 5825. | TTAGAGAAAAGATCAATCACTTTG[T,A]GACCAAGGGGCTCCCCTAGTTATCA | 2,252,137 | 84 |
| 5826. | CTTCCAGTCTGCCAGACCCACTAG[G,A]GATTTAATTAGATATTGGGGTGAAA | 2,252,137 | 84 |
| 5827. | CTAGGGATTTAATTAGATATTGGG[G,A]TGAAAGAGATTCTTTGTACAACGCA | 2,252,137 | 84 |
| 5828. | GTTACAATTAAGATAATATGTGCC[G,C]AACAATATTAACTCGGACAACTACG | 2,252,174 | 84 |
| 5829. | GTACTATATGATTGCTAATTGGGT[T,G]ACAATTAAGATAATATGTGCCGAAC | 2,252,196 | 84 |
| 5830. | ATAAACAAATGTTTCATGCATTTA[G,C]ATTGTACGTCATTATTAGCCGGATC | 2,252,448 | 84 |
| 5831. | CATTAATATTAATTGATTCTTACC[A,G]ATTACAAACGAAAATTTTGTTTATA | 2,252,645 | 84 |
| 5832. | ATGTCTCCATCGATCTCTACGCAG[T,C]ACTCCTTTTAATTTTTATGTTAAAT | 2,253,020 | 84 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 5833. | AAATGGTTTCTTCTCACTATAGCA[G,A]TGATTCGCTAGCTGGCTAGATGTCT | 2,253,064 | 84 |
| 5834. | GCTTGACTTGTCCTATATATATGT[G,T]CATGGTTGCTTTTGTGGTTAGGCTC | 2,253,184 | 84 |
| 5835. | GATTATGAGTTGATTATTGGCTCT[A,G]AGATGCATATCTAATCAGTCTTAAA | 2,254,302 | 84 |
| 5836. | TTGGACGTACGTACGTACGTACCC[T,C]AACGGACTAGGAAGACGGGATTCTT | 2,254,445 | 84 |
| 5837. | GATTATGAGTTGATTATTGGCTGT[A,G]AGATGCATATCTAATCAGTCTTAAA | 2,254,445 | 84 |
| 5838. | ATGCCATGGCTTCTTGACATTATC[C,T]ATCCCTTTATTCGTGGCTGAACCAG | 2,254,445 | 84 |
| 5839. | GCTTGACTTGTCCTATATATATGT[G,T]CATGGTTGCTTTTGTGGTTAGGCTC | 2,254,445 | 84 |
| 5840. | AAATGGTTTCTTCTCACTATAGCA[G,A]TGATTCGCTAGCTGGCTAGATGTCT | 2,254,445 | 84 |
| 5841. | ATGTCTCCATCGATCTCTACGCAG[T,C]ACTCCTTTTAATTTTTATGTTAAAT | 2,254,445 | 84 |
| 5842. | TGACAAAATCATCAAAGTCTGGCA[C,T]TTTATGATAATTCTCTTTGTGGTTC | 2,254,445 | 84 |
| 5843. | CATTAATATTAATTGATTCTTACC[A,G]ATTACAAACGAAAATTTTGTTTATA | 2,254,445 | 84 |
| 5844. | GTACTATATGATTGCTAATTGGGT[T,G]ACAATTAAGATAATATGTGCCGAAC | 2,254,445 | 84 |
| 5845. | GTTACAATTAAGATAATATGTGCC[G,C]AACAATATTAACTCGGACAACTAGC | 2,254,445 | 84 |
| 5846. | GAACCATCCAAATCTCGATCAAGA[A,T]AGGTATGTGGTGGATAATAGGATGA | 2,255,146 | 84 |
| 5847. | GACCAACCTGCATACCTTAATTCC[A,G]TCCAGCTACTTGGATGAGTTTTCTC | 2,255,379 | 84 |
| 5848. | ATATATAAGAGATCGACGATGATC[G,A]ATCTAGCTTGCAGACATATTGACAC | 2,255,577 | 84 |
| 5849. | TCAGCCAAATATATAAGAGATCGA[C,A]GATGATCGATCTAGCTTGCAGACAT | 2,255,585 | 84 |
| 5850. | CTATAGATGGAGCTTTTCTATTCC[C,T]TCTCTTCCTCCTCTCCATTTTCTAT | 2,256,565 | 84 |
| 5851. | ACTATAGATGGAGCTTTTTCTATTC[C,A]CTCTCTTCCTCCTCTCCATTTTCTA | 2,256,566 | 84 |
| 5852. | GGCTCAATGTGGACCAAATTTTAA[A,G]GTGTATTTCCTAACAAGCATGCATA | 2,256,636 | 84 |
| 5853. | GGAACTTACCACTCAATCGTTGTA[C,T]AAGAGTCTCTCAAGAAAAAATCCCA | 2,257,371 | 84 |
| 5854. | TGAGAGAATAAAATAAGATCAATA[C,T]AAGAGGAACTTACCACTCAATCGTT | 2,257,400 | 84 |
| 5855. | AAAGAAGAAACAAAATAAGAAACA[C,T]AATACAAATACGTGGATCGATCTCA | 2,257,483 | 84 |
| 5856. | CTCGATCCATCACCGCTGCAGCCTA[C,T]ACTCTGGCACCACCTTGCTCTGATA | 2,257,582 | 84 |
| 5857. | CTTGTTGGATGAGCACGTCTTTCA[T,C]CCTTGCCTGCCACAAAGAGAAATTG | 2,257,950 | 84 |
| 5858. | GCACGCTCTATCCCTCAATCATCC[G,A]CAGTTGATAAAACTGCCTCCATCGA | 2,257,950 | 84 |
| 5859. | CTTGTTGGATGAGCACGTCTTTCA[T,C]CCTTGCCTGCCACAAAGAGAAATTG | 2,257,950 | 84 |
| 5860. | CTCGATCATCACCGCTGCAGCCTA[C,T]ACTCTGGCACCACCTTGCTCTGATA | 2,257,950 | 84 |
| 5861. | AAAGAAGAAACAAAATAAGAAACA[C,T]AATACAAATACGTGGATCGATCTCA | 2,257,950 | 84 |
| 5862. | TGCATGCCGAATCTAAAATCCACT[G,A]CTGGAAAGAAGTAGATTCCTCGTCA | 2,258,463 | 84 |
| 5863. | TCACCAGAAAATTCATTAAACTTC[G,A]ATCCCTCTGATTAGTCCATCCATCT | 2,258,463 | 84 |
| 5864. | AGATCCAAAAATTTCTTTCCCACC[G,A]ATGGCTCCATGGCAGAGCAACAAAA | 2,260,135 | 84 |
| 5865. | GATCATCATGTCCATCGTGAAAAC[G,C]GATCAAAGTCTAGACAATACCTTTC | 2,260,406 | 84 |
| 5866. | AGATCCAAAAATTTCTTTCCCACC[G,A]ATGGCTCCATGGCAGAGCAACAAAA | 2,260,406 | 84 |
| 5867. | AGTCATACCAGCCATGATGAAATT[A,T]GTTGCATTATCGGTAATTACTTGGA | 2,260,406 | 84 |
| 5868. | CCATGATGAAATTAGTTGCATTAT[C,T]GGTAATTACTTGGACAACATTTGCC | 2,260,406 | 84 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 5869. | AAAAATAAGACACAGATGAATTAT[C,T]AAGAAGGAGACCAAACAGCAATCAA | 2,260,750 | 84 |
| 5870. | GGATGGCAAAAATTTTATTTGCCA[T,A]AGATGCATCAAAATTTTATAAATTA | 2,260,979 | 84 |
| 5871. | ATAGAGATTAAAAAGCAGTCCAAG[G,A]TCTAAGAATATTCGTTACGACTGGA | 2,261,026 | 84 |
| 5872. | CAGATGTTATCTTTAGTACTGTAC[C,A]CTATAGAGATTAAAAAGCAGTCCAA | 2,261,053 | 84 |
| 5873. | ATGACATAGTAAGGTTCAAATAGG[T,C]GGAGTTGGAATGGGAGAGTCTTCAT | 2,261,112 | 84 |
| 5874. | TAGAATTCAAACAAAAGATGACAT[A,T]GTAAGGTTCAAATAGGTGGAGTTGG | 2,261,129 | 84 |
| 5875. | TGATTTTACCTGGTGGGTTACCTG[G,T]CTGGGCTATTTACCGTCCTTCCGTG | 2,261,447 | 84 |
| 5876. | ATGCGCTCCCAACATGATTTTACC[T,C]GGTGGGTTACCTGGCTGGGCTATTT | 2,261,461 | 84 |
| 5877. | GCAATTTACCATCCAGATACATGC[G,T]CTCCCAACATGATTTTCAATGGTGG | 2,261,481 | 84 |
| 5878. | AAAAAAaTTAAAAaTAAAGTCGA[G,A]AGGAGGGAGAGTAAGAGAGCCCAAT | 2,261,549 | 84 |
| 5879. | TAGAATTCAAACAAAAGATGACAT[A,T]GTAAGGTTCAAATAGGTGGAGTTGG | 2,261,549 | 84 |
| 5880. | ATGACATAGTAAGGTTCAAATAGG[T,C]GGAGTTGGAATGGGAGAGTCTTCAT | 2,261,549 | 84 |
| 5881. | CAGATGTTATCTTTAGTACTGTAC[C,A]CTATAGAGATTAAAAAGCAGTCCAA | 2,261,549 | 84 |
| 5882. | ATAGAGATTAAAAAGCAGTCCAAG[G,A]TCTAAGAATATTCGTTACGACTGGA | 2,261,549 | 84 |
| 5883. | GGATGGCAAAAATTTTATTTGCCA[T,A]AGATGCATCAAAATTTTATAAATTA | 2,261,549 | 84 |
| 5884. | ATTTTAAACAAATGCAAAAACAAT[T,A]TGCAATGTAGAATTAGAAATTAGAA | 2,261,549 | 84 |
| 5885. | AAAAATAAGACACAGATGAATTAT[T,C]AAGAAGGAGACCAAACAGCAATCAA | 2,261,549 | 84 |
| 5886. | GGTGGTGGTGGAGGCGAAAGAGGC[A,G]TCGCTGTGAGAGATTGAATGGCTTT | 2,261,994 | 84 |
| 5887. | GTGATCTTGCCATCGCCATCGACA[C,T]GGTTGAAGACGGCGAAGAGGTCGAA | 2,262,176 | 84 |
| 5888. | TTCGTTTAACTTGTGGAATCTCCC[C,T]AATATCTTCCAACATTAGATCTATG | 2,262,176 | 84 |
| 5889. | AAAATAATTCATTTTTTTCATAAT[T,C]GAATCCGGACTCACCCTAATAAAAT | 2,262,440 | 84 |
| 5890. | TAAATATACATTTTAAGCCCCACT[G,A]GGGTCCAACGCATCTTATATTTTCG | 2,262,645 | 84 |
| 5891. | AAAATAATTCATTTTTTTCATAAT[T,C]GAATCCGGACTCACCCTAATAAAAT | 2,262,645 | 84 |
| 5892. | GCCAAGTGGTGATGTGTTTTGGTC[C,T]GCGGTCACCTTGCACGATGTATCAA | 2,262,758 | 84 |
| 5893. | TCTTTGTGTGGCTCTCGTGGACAC[C,A]AAATATTTTTATATATGTTTGCACG | 2,262,830 | 84 |
| 5894. | GATGACCATGTCCGCACTTGATCT[G,T]AGCCAAAAGGCTGAGAAAGGTATAC | 2,263,024 | 84 |
| 5895. | CGGACAATTGATTTGATTATAGTT[G,A]GTAAATAAGATGTTATCGGTGATGA | 2,263,069 | 84 |
| 5896. | TCATTTAAAAGCCGAAATTAATGA[T,G]GCTTAAGATGCTTGAGGATGTATCT | 2,263,444 | 84 |
| 5897. | TTGAACAAAAGAGGAGTAGGTGTA[G,A]AACCCTTTAGCAGGGCAGGCACTAT | 2,264,187 | 84 |
| 5898. | TCATTTAAAAGCCGAAATTAATGA[T,G]GCTTAAGATGCTTGAGGATGTATCT | 2,264,187 | 84 |
| 5899. | CAAGTACACATGCATGCATGCATG[T,C]ATGTATGAATCCAAGGTTGATGTAT | 2,264,341 | 84 |
| 5900. | AGTTGTAGTTCCTGCCAGGGTCCA[T,A]TGTTTTGAGCTATACAATTAGAGCA | 2,264,792 | 84 |
| 5901. | CTACCAGAAAAGTAGATAAATACG[T,A]AAACCAAGGCCATAGGAATTGCAGA | 2,265,400 | 84 |
| 5902. | TATTTAGTAAAGTGTTTGGAGAGA[G,T]AGGAAGTATTTTTTGTCTTTCAAAA | 2,266,061 | 84 |
| 5903. | AGAGCTTGAAGAATTATCTGATTT[T,C]AAAAATAAAATATTTTTTTtGGATA | 2,266,238 | 84 |
| 5904. | AAACTTTCATATCGATCAATCATT[C,T]TGAAACTTAAATAAAAGATTTTGGA | 2,266,328 | 84 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 5905. | TATTTTTCAAATAATTGGAACATA[C,A]ATTTGAATAAACTCTTTTTCGAAAA | 2,266,380 | 84 |
| 5906. | ATCTTGCAATCGAGTCAACTCAAA[A,T]TTTTTAAAGAAATTTAGAAAAaTAA | 2,266,779 | 84 |
| 5907. | TCACAGAAAGAGAGTCATTTTGCT[G,A]GATGATCTAGTCGAGGAAAAGCAAA | 2,266,828 | 84 |
| 5908. | AAAGGTAGTTAGCCTCGATATTTA[A,G]AGGACAATTTACTTAGATTATGTTC | 2,267,067 | 84 |
| 5909. | AAATTTCAAATTTTCAATGAATCC[T,A]ACAGGCATGGTGGAAGATGTCTTTG | 2,267,203 | 84 |
| 5910. | CTTTAAGCTTTTGATTGTACTTGA[C,T]GTACACTAAATCACTAAGCTTCTTT | 2,267,203 | 84 |
| 5911. | GTACCAATCAATCATTTATCAAAA[T,C]TTGTTTAAAAATATAATATTACTAT | 2,267,203 | 84 |
| 5912. | CTACCAGAAAAGTAGATAAATACG[T,A]AAACCAAGGCCATAGGAATTGCAGA | 2,267,203 | 84 |
| 5913. | CCTGTTCAAACACACTCCAATTAC[G,A]CTCACAACCAGATGCACACCATTCC | 2,267,203 | 84 |
| 5914. | AGTTGTAGTTCCTGCCAGGGTCCA[T,A]TGTTTTGAGCTATACAATTAGAGCA | 2,267,203 | 84 |
| 5915. | TTTCGCGTAAAAGATACAACCTAC[A,G]TCCATAAAGAACCAGCTCCTCAAGG | 2,267,577 | 84 |
| 5916. | CTAATAGTTATGGCAACCAATACT[C,T]ATCCAAATTTGCTTAGATTTAAAT | 2,267,758 | 84 |
| 5917. | CATATTAATTTTGCTAATAGTTAT[G,T]GCAACCAATACTCTATCCAAATTTG | 2,267,771 | 84 |
| 5918. | TATGTATGCATACCCTCACGTGAA[A,G]CCATCATGTGCCCCTTGTATGTATG | 2,267,919 | 84 |
| 5919. | CATCTTTGGTCTGTGAAAGGCTTC[A,G]CCAATTATGTATGCATACCCTCACG | 2,267,949 | 84 |
| 5920. | ATGAAATAATGAGGTAGGCGAAGA[C,T]CGATATAACCGCCATTATACCGTTA | 2,268,109 | 84 |
| 5921. | ATCTTTTTCTTTTGGAGTGCAAAC[G,A]TAAATAGGTCAAAATTTAAGGAATA | 2,268,381 | 84 |
| 5922. | AGATTGGTGGGAGAAAGTCGATAA[T,C]GGGTGACAATTGGGAGGAAGATGGTG | 2,268,656 | 84 |
| 5923. | GGGCGATGGCAGCGAAAAGAGCAG[G,A]GAGGAGGTCGATGTCTCTCTTTTTC | 2,268,880 | 84 |
| 5924. | TCAAAACTCAACACGTGGTTTGAT[A,G]GAGATTTTTAAGAATAaAAAAAATC | 2,269,154 | 84 |
| 5925. | TATTTTTCCTTCCTTCTCTAACAC[T,C]TGCTGCCCTAGCTACTGCACCCCAT | 2,269,154 | 84 |
| 5926. | GGGCGATGGCAGCGAAAAGAGCAG[G,A]GAGGAGGTCGATGTCTCTCTTTTTC | 2,269,154 | 84 |
| 5927. | TTTTAGAAGTTTCTTGATTTTAGC[A,G]TGATCAAAACTCAACACGTGGTTTG | 2,269,182 | 84 |
| 5928. | GCAACATAAATGTTCTTTTTAGAA[G,A]TTTCTTGATTTTAGCATGATCAAAA | 2,269,198 | 84 |
| 5929. | ACACATTATCTATTACGATGGGCC[G,A]TCACCATAACTCCTATCATCATTAT | 2,269,380 | 84 |
| 5930. | TTTTAGAAGTTTCTTGATTTTAGC[A,G]TGATCAAAACTCAACACGTGGTTTG | 2,269,380 | 84 |
| 5931. | AAAaGTTATGTGGAGCTTGATCAC[A,G]TTCAAGCTCAGATAAGCTCAAGCTC | 2,269,570 | 84 |
| 5932. | GTGTTCATATATAATCAATTGTTA[C,T]ACTAAATGTAGTGACTGCCCTTCAT | 2,269,882 | 84 |
| 5933. | TAAGTTTGGTGGCTTTGAATGTGA[A,G]GTTGAAGCTGCTGTTGATCTTGATC | 2,270,882 | 84 |
| 5934. | TAATGGTTTATCTCAAAACTAGCC[G,A]CCCATCAATATGGCCACAATCATGC | 2,270,189 | 84 |
| 5935. | TAATTATTGGATCAACACTCATCT[C,T]TCTATTTAAGTAAAAATAATCCAAG | 2,270,240 | 84 |
| 5936. | AAAAaTATTCAAATATTTTATATT[T,C]ATCAAAATTAATTATTGGATCAACA | 2,270,273 | 84 |
| 5937. | TGTGGCTTCTTCCATCTTTTTTTt[A,G]CACTCTATAACTTGGCATTGATGAA | 2,270,394 | 84 |
| 5938. | TCAATCTCTTCTTCTGAACTAGAA[C,T]GAATCTCTTCATGATTTAAGTTTGG | 2,270,394 | 84 |
| 5939. | GTCAGCTCTTGACTTTTTTCATTT[G,A]ATTTCTCATGATGTGGCTTCTTCCA | 2,270,430 | 84 |
| 5940. | TTGTATATTTCTGAAATTTATGCA[G,T]AACTAGCCATAAAAGTTGTTAACCG | 2,270,755 | 84 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 5941. | ATTGTATATTTCTGAAATTTATGCA[G,A]CTTGATTATTTTTCTTAACTAACAA | 2,271,266 | 84 |
| 5942. | TCCTCAAACCATCCTTAAAAATTT[T,C]ATTATGATTTTTCCTCAGATTATAG | 2,271,291 | 84 |
| 5943. | TATTTATTCCTCAAACCATCCTTA[A,G]AAATTTATTATGATTTTTCCTCAG | 2,271,298 | 84 |
| 5944. | AAAAGTAAATAATAAGACACAAG[C,T]AAATACAAAAAAATTTATAGTGATT | 2,271,369 | 84 |
| 5945. | ATTGTGTGTGTGTGTGACAAAA[A,C]AGATTAGCAATGCAATGTCTAGAAC | 2,271,713 | 84 |
| 5946. | ATCTTCCATCTCCTTCCCGAAATA[A,C]AaGGAAAATTAAGGTAAAAGAAAGC | 2,271,936 | 84 |
| 5947. | CAAGAAACAGCACATTGGCTGCTA[A,T]ATTGTTCCAAACGAAGGAAGTTCTA | 2,272,047 | 84 |
| 5948. | GGTTGCTTTATATATATATATATA[T,C]ACAAGCGATCAAATTGATCCTTTTG | 2,272,119 | 84 |
| 5949. | TACGGGAAAAATATAAAACATGA[G,C]GTTGCTTTATATATATATATATA | 2,272,143 | 84 |
| 5950. | TCTGCCAATTAGTTTGTATACGGG[G,A]AAAAATATAAAACATGAGGTTGCTT | 2,272,161 | 84 |
| 5951. | TAAAATTTAAAATTTGGATGGCTA[T,C]GCCTCCTGTTACATCGGGAAACAAA | 2,272,373 | 84 |
| 5952. | TTCTTCAATAATGTTGTGGGAAAC[T,C]GTATTCTATTTTAGTTTCCCTCCCC | 2,272,506 | 84 |
| 5953. | CAAGAAACAGCACATTGGCTGCTA[A,T]ATTGTTCCAAACGAAGGAAGTTCTA | 2,272,506 | 84 |
| 5954. | ATATGTGTAGCTGCCCTCTGGAAC[A,G]GAATGCTTTGGTAGAGCATAATAAG | 2,272,625 | 84 |
| 5955. | TGGGTGGGAGTGAGGGTGGAGCTG[A,T]GGTGGTGATGGACTTGGTGGGAGGT | 2,272,840 | 84 |
| 5956. | TTCTCACAAACCCCACAATCATGG[A,C]ATTCCACGATACACGGTTTCTCTGA | 2,273,379 | 84 |
| 5957. | AAGCTTGTTTCTCACAAACCCCAC[A,T]ATCATGGAATTCCACGATACACGGT | 2,273,387 | 84 |
| 5958. | TGTGGTGGTVVTVSYYHVSHVSVS[C,T]ACAGCCACCTCTATCAATTAGATTT | 2,275,059 | 84 |
| 5959. | AAAACTGTTGTTTGCAAGAAAGAT[T,A]CCCTGCTGCCAAATTGGGCAGCTGG | 2,275,332 | 84 |
| 5960. | AAGCTTGTTTCTCACAAACCCCAC[A,T]ATCATGGAATTCCACGATACACGGT | 2,275,332 | 84 |
| 5961. | TTCTCACAAACCCCACAATCATGG[A,C]ATTCCACGATACACGGTTTCTCTGA | 2,275,332 | 84 |
| 5962. | GGTACTAGGCGCTGAAAAAGCGAA[A,C]ACCTGATTGAAGTCAGATGCCATGT | 2,275,332 | 84 |
| 5963. | CACCTGCACACCATAAGCTGAAGG[T,A]TGTCCTACCAATTTGAGCTTCACAA | 2,275,443 | 84 |
| 5964. | AATTTTTAAGCCTGGATTGGTACT[T,C]ATTTTTGGGCTATTCTATCTTGTAC | 2,275,594 | 84 |
| 5965. | CACTACTAACTATAGGATATCGGT[A,C]AAGTTTATTATGCAATTCTCCTGTT | 2,275,650 | 84 |
| 5966. | TTTCCATTTGGAGGGGTGAGATCA[C,G]GGGGCAAACGCCCTGCACTACTAAC | 2,275,690 | 84 |
| 5967. | GCAAGGGAGGGAGACGGTACCTGT[T,G]GGAATTACCTAGAATTGAAGATTGA | 2,275,771 | 84 |
| 5968. | AAAATAAAAGCAAGGGAGGGAGAC[G,A]GTACCTGTTGGAATTACCTAGAATT | 2,275,780 | 84 |
| 5969. | TGATCAAAATTGGTCTCGAGGAAA[G,A]GGAGAGGGATGGTGGCTTCCAAGAA | 2,276,364 | 84 |
| 5970. | TGTCAAATCAAGAAGTTGGAGCTC[T,C]TGATGCAAGAGGAGAGCTAAATGAT | 2,277,100 | 84 |
| 5971. | AAATGGTGGTACTTGTGAGCCCAT[G,T]ATTGTCAAATCAAGAAGTTGGAGCT | 2,277,127 | 84 |
| 5972. | ACAGTTACAGTAAGAGGGACAACC[A,T]GCTCAAAATAGTTTTGTGGCTTTCT | 2,277,525 | 84 |
| 5973. | TGATCAAAATTGGTCTCGAGGAAA[G,A]GGAGAGGGATGGTGGCTTCCAAGAA | 2,277,525 | 84 |
| 5974. | ATAAGGAGGGAATGGTATAATGAA[C,G]AGGAGACAGTTACAGTAAGAGGGAC | 2,277,555 | 84 |
| 5975. | GAGAGAATCGAAGCAAAAGACTC[G,A]TGAGGGCAATTATTACGCAAATATA | 2,278,007 | 84 |
| 5976. | AGTGGCCAAAAAGGAAGTGTCTAC[T,C]AGAAAATTGAGAGAGAATCGAAGCA | 2,278,042 | 84 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 5977. | GCAAGAAAAACCAGAGCGAGCAAA[A,C]AGGGTAGCAATGAAGCAGAACATGT | 2,278,316 | 84 |
| 5978. | TCCCATGTGTtTTTTTGCAAGAAA[A,G]ACCAGAGCGAGCAAAAAGGGTAGCA | 2,278,332 | 84 |
| 5979. | AATGGTTTGGCGAGGCCCAAAAAA[T,A]ACATTTTAGCCTGATTGGGCCAGA | 2,278,873 | 84 |
| 5980. | TTCTAACACACCTTCGTAGAATAT[A,C]GATCAAAATTAACGCAATTAAATCA | 2,279,223 | 84 |
| 5981. | TCTTATCTTTGTAGCCCACAGACT[C,T]TAGCTGAAAGCAGAAAGAACTAATG | 2,279,454 | 84 |
| 5982. | ATATTTGTCGCTTTTGTTGTCCAT[A,T]ACATTATTGTGGGGTGCAAATCTTT | 2,279,741 | 84 |
| 5983. | TTTTCAATCCTTTAAAATTTGTGC[T,C]AGAGAATTAAGAAAATCCGGATCCT | 2,280,097 | 84 |
| 5984. | ATATTTGTCGCTTTTGTTGTCCAT[A,T]ACATTATTGTGGGGTGCAAATCTTT | 2,280,097 | 84 |
| 5985. | TCTTATCTTTGTAGCCCACAGACT[C,T]TAGCTGAAAGCAGAAAGAACTAATG | 2,280,097 | 84 |
| 5986. | TCAAAAGTATTCTATTTATATTTC[T,G]ATAGGTCAAGAATGTTTGGTTTGCT | 2,280,097 | 84 |
| 5987. | TTCTAACACACCTTCGTAGAATAT[A,C]GATCAAAATTAACGCAATTAAATCA | 2,280,097 | 84 |
| 5988. | AATGGTTTGGCGAGGCCCAAAAAa[T,A]ACATTTTAGCCTGATTGGGCCAGA | 2,280,097 | 84 |
| 5989. | TCCCATGTGTTTTTTtGCAAGAAA[A,G]ACCAGAGCGAGCAAAAAGGGTAGCA | 2,280,097 | 84 |
| 5990. | GCAAGAAAAACCAGAGCGAGCAAA[A,C]AGGGTAGCAATGAAGCAGAACATGT | 2,280,097 | 84 |
| 5991. | TTCCTTTTCAATCCTTTAAAATTT[G,A]TGCTAGAGAATTAAGAAAATCCGGA | 2,280,101 | 84 |
| 5992. | AGAATTGGAGTCATTTTAATCCAA[G,A]TTTTAGTGAGATTATTTCTGATTTT | 2,280,239 | 84 |
| 5993. | TCTAACGAGGATAAACAAGAAAAA[C,T]CTAATGATTTCTCCGATGAAAACCC | 2,280,383 | 84 |
| 5994. | AGAATTGGAGTCATTTTAATCCAA[G,A]TTTTAGTGAGATTATTTCTGATTTT | 2,280,383 | 84 |
| 5995. | AAGGCTTAATAACTTACCTAGGTC[T,C]AACGAGGATAAACAAGAAAAACCTA | 2,280,405 | 84 |
| 5996. | GCCATGGCCGTAGAATACTAGCCA[G,A]CAACCAATGTCAGCACTCGGTGCCT | 2,280,607 | 84 |
| 5997. | CTCTCTTCTTTAAACAAAGCACCC[A,G]AATTTTATTCTTTTTCCCTCTTCAT | 2,280,660 | 84 |
| 5998. | AACACTACTAGTCCAGAACCTCTC[T,C]CAGGGTCACCAATTGATCTGGGTTA | 2,280,920 | 84 |
| 5999. | AAAAAAaTAAATATACATAATATT[A,G]TTTGTGTCCAACAATCCTTATCTCT | 2,281,141 | 84 |
| 6000. | TACCTAAACCATCTGAAAACCTTC[C,A]ATATTTGATACGAGCATATGACATA | 2,281,261 | 84 |
| 6001. | CAAGACTATTCGCAATCTAACGTG[C,G]CTAATCCAAATATCCCTTTCTTAAT | 2,281,395 | 84 |
| 6002. | ATGACAAGACTATTCGCAATCTAA[C,T]GTGCCTAATCCAAATATCCCTTTCT | 2,281,399 | 84 |
| 6003. | TTTCTGTCCATGACGAGCTATTCT[T,C]AGTATCACATTTCTATCCATGACAA | 2,281,442 | 84 |
| 6004. | CAAGACTATTCGCAATCTAACGTG[C,G]CTAATCCAAATATCCCTTTCTTAAT | 2,281,442 | 84 |
| 6005. | TACCTAAACCATCTGAAAACCTTC[C,A]ATATTTGATACGAGCATATGACATA | 2,281,442 | 84 |
| 6006. | TGGACCGCTATGGGAGGTCTAATC[A,G]TGGATCTATTTAAGTTGGGCTAGT | 2,281,442 | 84 |
| 6007. | AAAAAAaTAAATATACATAATATT[A,G]TTTGTGTCCAACAATCCTTATCTCT | 2,281,442 | 84 |
| 6008. | CTCTCTTCTTTAAACAAAGCACCC[A,G]AATTTTATTCTTTTTCCCTCTTCAT | 2,281,442 | 84 |
| 6009. | CACATTAACATAATCTGAATCAAT[T,C]AACAGTTATCTTTAGGATTCTGAAC | 2,281,679 | 84 |
| 6010. | ACAAAAATATATATCATATATCAT[C,T]GGATATCCCTCTTCTTCAAACTATT | 2,281,795 | 84 |
| 6011. | CAAAAGAAAATATAAGCTATAAAA[C,T]CTCGTATCATGTATCCAATATAACT | 2,281,859 | 84 |
| 6012. | ATCTGATCAAATTTTTCAATTCGA[G,A]ATCCCAACCTTAGCTAAATATGAAC | 2,282,023 | 84 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 6013. | ACTGTTATTGATGATGTTCTATCT[G,A]ATCAAATTTTTCAATTCGAGATCCC | 2,282,043 | 84 |
| 6014. | TCAAATTTTATATAATTTATAAAA[C,A]TCAATTATTCAACTGTTATTGATGA | 2,282,079 | 84 |
| 6015. | ACAAAAATATATATCATATATCAT[C,T]GGATATCCCTCTTCTTCAAACTATT | 2,282,079 | 84 |
| 6016. | TATTAACAAATATCAAATTTTATA[T,C]AATTTATAAAACTCAATTATTCAAC | 2,282,091 | 84 |
| 6017. | TTCATAATAAATATTTTATATTAA[C,T]AAATATCAAATTTTATATAATTTAT | 2,282,109 | 84 |
| 6018. | GTCGGCTACATGATGTGGGCCCAT[A,G]AACCTTAGAGTAACATCCTAGAGAT | 2,282,218 | 84 |
| 6019. | CAAACCCAGCACCCAGGTCGGCTA[C,T]ATGATGTGGGCCCATAAACCTTAGA | 2,282,234 | 84 |
| 6020. | TGTATTAGAAGAGCCAAACTAATT[A,G]AAGTGCTGAACAAACTATGCTGGCA | 2,282,309 | 84 |
| 6021. | TCACAAGAGCTGATAAATGTTAGC[A,G]TCCGCCACCGACTCCATTTTTGTCT | 2,282,889 | 84 |
| 6022. | TGTATTAGAAGAGCCAAACTAATT[A,G]AAGTGCTGAACAAACTATGCTGGCA | 2,282,889 | 84 |
| 6023. | CAAACCCAGCACCCAGGTCGGCTA[C,T]ATGATGTGGGCCCATAAACCTTAGA | 2,282,889 | 84 |
| 6024. | GTCGGCTACATGTGGGCCCAT[A,G]AACCTTAGAGTAACATCCTAGAGAT | 2,282,889 | 84 |
| 6025. | CCAACAGCCCCACTGAACTGGCAG[T,G]GCAATTCATGAAAGTTATTTAT | 2,282,889 | 84 |
| 6026. | TTCATAATAAATATTTTATATTAA[C,T]AAATATCAAATTTTATATAATTTAT | 2,282,889 | 84 |
| 6027. | TATTAACAAATATCAAATTTTATA[T,C]AATTTATAAAACTCAATTATTCAAC | 2,282,889 | 84 |
| 6028. | GATACAAGAACCAAATTATCTCAT[T,C]GATGATCTCCTGCTCCATCATTTGC | 2,283,818 | 84 |
| 6029. | AATTAATCAGAAATGGAATCATGT[A,T]CTTCTCTATGTATATATCCATGTTT | 2,283,897 | 84 |
| 6030. | GGGACAATTGTGGAGAGGGCCAAG[T,A]CTTCTCTATGTATATATCCATGTTT | 2,284,596 | 84 |
| 6031. | AGCCATACATCTCCTAGATAACAG[C,T]ATGAGATATGGTTGTAAACTTTGCA | 2,284,596 | 84 |
| 6032. | TGATAGAATATATAAAGTTGGGGA[C,A]AATTGTGGAGAGGGCCAAGTCCAAC | 2,284,616 | 84 |
| 6033. | TTACTTTTCCTACCACTGTCTTGT[G,A]TGACAATCTTGTTTGATTGTTGGGT | 2,285,645 | 84 |
| 6034. | GTATGATGATTTTTCTTAACAAGA[T,C]GGGATTTATGATTTGACCTTTTCTT | 2,285,645 | 84 |
| 6035. | AACAGCTTCTTCCTTAAGCCTTTT[T,C]CTTGCCCCTCCCCTCCTACCATTAC | 2,286,266 | 84 |
| 6036. | TGCCTCGTTGTTTCTAAAGTTCAC[T,A]GTCTCCATAAAGAATGCACCTTTGT | 2,286,321 | 84 |
| 6037. | TGGGGAACTCCGATCCAATCCTTT[A,G]GTCTCGACTGGTGAAATCAAAGCTT | 2,287,839 | 84 |
| 6038. | TCTTGCGTGTGAGGATGGAACTCG[T,C]AGCAGAACCACACCTCCATTGTCAT | 2,288,047 | 84 |
| 6039. | CACATTGGTATCACCAAGTGGGTG[G,A]GAGGTCTTGCGTGTGAGGATGGAAC | 2,288,076 | 84 |
| 6040. | ACGAAATCCAAACATTTGTTATCA[T,C]GACACTAAATTAATTTTGGACTTCC | 2,288,400 | 84 |
| 6041. | TTTATTAAAGTACGAAATCCAAAC[A,T]TTTGTTATCATGACACTAAATTAAT | 2,288,411 | 84 |
| 6042. | ATTGTGGAGTGAAAGAAAATCATC[G,A]GAGTACCATTGACTAGGATGGCAAG | 2,288,656 | 84 |
| 6043. | TATAAGGAGAAAGAGGATAATCTT[G,A]GGGAAATCCGATTGTGGAGTGAAAG | 2,288,691 | 84 |
| 6044. | ACCATCGCCCAACCTAGCAAGAAA[T,C]AGTCATTTGTCAAGAGTAAGTGAGG | 2,288,843 | 84 |
| 6045. | ATACCATCGCCCAACCTAGCAAGA[A,G]ATAGTCATTTGTCAAGAGTAAGTGA | 2,288,845 | 84 |
| 6046. | GCCTTCGATGAGGTTTAATCTTTA[G,A]GCTAAAGTAGATAACCAACTTTAGT | 2,288,962 | 84 |
| 6047. | CTGCCTTCGATGAGGTTTAATCTT[T,C]AGGCTAAAGTAGATAACCAACTTTA | 2,288,964 | 84 |
| 6048. | TACTCCCATGCCCAAATACTCCCT[G,A]ATCGTCTGCCTTCGATGAGGTTTAA | 2,288,994 | 84 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 6049. | TCTGACCCATGATCGGGACCCCTA[C,A]GTAGTGCCACACTTTGACCTACTCC | 2,289,038 | 84 |
| 6050. | CATCCTCTCCCTAATGCTTTACTT[C,T]ATCTTAATATACTTTGATCTCCACA | 2,289,091 | 84 |
| 6051. | TGATTGGACCAACATCACTTGACC[C,T]ATCATAGATAGCGACTTGACTTGCC | 2,289,148 | 84 |
| 6052. | CATCCTCTCCCTAATGCTTTACTT[C,T]ATCTTAATATACTTTGATCTCCACA | 2,289,148 | 84 |
| 6053. | TACTCCCATGCCCAAATACTCCCT[G,A]ATCGTCTGCCTTCGATGAGGTTTAA | 2,289,148 | 84 |
| 6054. | CTGCCTTCGATGAGGTTTAATCTT[T,C]AGGCTAAAGTAGATAACCAACTTTA | 2,289,148 | 84 |
| 6055. | GCCTTCGATGAGGTTTAATCTTTA[G,A]GCTAAAGTAGATAACCAACTTTAGT | 2,289,148 | 84 |
| 6056. | ATACCATCGCCCAACCTAGCAAGA[A,G]ATAGTCATTTGTCAAGAGTAAGTGA | 2,289,148 | 84 |
| 6057. | ACCATCGCCCAACCTAGCAAGAAA[T,C]AGTCATTTGTCAAGAGTAAGTGAGG | 2,289,148 | 84 |
| 6058. | TATAAGGAGAAAGAGGATAATCTT[G,A]GGGAAATCCGATTGTGGAGTGAAAG | 2,289,148 | 84 |
| 6059. | TTTATTAAAGTACGAAATCCAAAC[A,T]TTTGTTATCATGACACTAAATTAAT | 2,289,148 | 84 |
| 6060. | ACGAAATCCAAACATTTGTTATCA[T,C]GACACTAAATTAATTTTGGACTTCC | 2,289,148 | 84 |
| 6061. | CACATTGGTATCACCAAGTGGGTC[G,A]GAGGTCTTGCGTGTGAGGATGGAAC | 2,289,148 | 84 |
| 6062. | TCTTGCGTGTGAGGATGGAACTCG[T,C]AGCAGAACCACACCTCCATTGTCAT | 2,289,148 | 84 |
| 6063. | TGGGGAACTCCGATCCAATCCTTT[A,G]GTCTCGACTGGTGAAATCAAAGCTT | 2,289,148 | 84 |
| 6064. | GCTGATTGGACCAACATCACTTGA[C,T]CCATCATAGATAGCGACTTGACTTG | 2,289,150 | 84 |
| 6065. | TAGTTCAGGCTGAAGAGAGAGAGG[A,G]AAGAGAGAGAAACTCTCTTTCTCAT | 2,289,286 | 84 |
| 6066. | AGAGAGAAAATAGAGAGAGAAAGT[T,C]CAATTTTAGAGAGAGAAAATACTAG | 2,289,333 | 84 |
| 6067. | GAGAGAGAATTTTAGAGAGAGAAA[A,G]TAGAGAGAGAAAGTTCAATTTTAGA | 2,289,348 | 84 |
| 6068. | CACAGATCAAAAATTCATCATGAG[A,G]ATCATTTAAATTCATCATCATTCTT | 2,289,437 | 84 |
| 6069. | GTCGGTGTACCGTCCGACGATCAG[A,G]GATCAAAAATTCATCATGAGAATCA | 2,289,458 | 84 |
| 6070. | CATGATAAATAAAATCTAAAAATA[T,C]CTGATCTGATCAAAGTGGATGTCGG | 2,289,503 | 84 |
| 6071. | GTCGGTGTACCGTCCGACGATCAC[A,G]GATCAAAAATTCATCATGAGAATCA | 2,289,503 | 84 |
| 6072. | CACAGATCAAAAATTCATCATGAG[A,G]ATCATTTAAATTCATCATCATTCTT | 2,289,503 | 84 |
| 6073. | AGAGAGAAAATAGAGAGAGAAAGT[T,C]CAATTTTAGAGAGAGAAAATACTAG | 2,289,503 | 84 |
| 6074. | GTGAACAATTCAATAAAATCATGA[T,G]AAATAAAATCTAAAAATATCTGATC | 2,289,522 | 84 |
| 6075. | ATTAGATTAAAGAAAGAGATTGAC[T,C]TGCATTAATATAATCATATAGTTCA | 2,321,352 | 84 |
| 6076. | TTTGCAAACCATGGTCATATGGCC[G,A]CCATTAAATCAAAACTCAATAATTT | 2,321,352 | 84 |
| 6077. | AAGCGGCTATATGGCTTAGAAGAC[T,C]ATCAACTATGCCTAAGACATGCTGC | 2,321,650 | 84 |
| 6078. | AGCAGTTATATGGCCTTTTTTTTG[G,C]CGATAAAGCGGCTATATGGCTTAGA | 2,321,680 | 84 |
| 6079. | AATCTCCTAGCTAAGATTAAGAAA[C,T]GAAATCAAAACCAGTCGGAACCAAA | 2,322,179 | 84 |
| 6080. | TTGCGGAAGTCTGAGTGAAACCAT[G,A]GCTTCTATCCGCGAGCACGGTTTCG | 2,323,099 | 84 |
| 6081. | GCTATTATTGTTATGCACATTGCC[G,A]TCATGATCGGCATCTGGCTTCTCGA | 2,323,632 | 84 |
| 6082. | TGTTTTCTACATTCATGCCATTCT[C,G]ATGTGCATCATGTGGATATATACAT | 2,323,632 | 84 |
| 6083. | TTGCGGAAGTCTGAGTGAAACCAT[G,A]GCTTCTATCCGCGAGCACGGTTTCG | 2,323,632 | 84 |
| 6084. | TTTAAAAGAAAAGAAAATAGGAGC[G,A]TGATTTGACATTCAAATCATGATG | 2,323,632 | 84 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 6085. | TTTCGGTCTCATTCCTTCCTGAGA[G,T]CTGACGCTTAACGCAGTCGGGCACT | 2,323,684 | 84 |
| 6086. | TTTTCGGTCTCATTCCTTCCTGAG[A,C]GCTGACGCTTAACGCAGTCGGGCAC | 2,323,685 | 84 |
| 6087. | ATTCTTTTGACTTACTTCGCTCTG[A,G]TTACCGGATTCTTCTCCTTCATAAT | 2,323,830 | 84 |
| 6088. | AAGTAGAAGAATTCAGTACGCATC[C,T]ATGATTCTTTTGACTTACTTCGCTC | 2,323,858 | 84 |
| 6089. | GCACAACAATCCAAGTAGAAGAAT[T,G]CAGTACGCATCCATGATTCTTTTGA | 2,323,870 | 84 |
| 6090. | AGTTGCATCCAAACTCACTCTTTC[T,A]GACAAATTATGCACTTCTGCAGCAC | 2,324,017 | 84 |
| 6091. | AACTAAGAAGGATTATTCGAGTCA[A,G]GCAGGTTAGTTGCATCCAAACTCAC | 2,324,049 | 84 |
| 6092. | GTTCAGATATCAGGCATTCTTCAT[T,C]TAAGTTATGAATCCAAACTAAGAAG | 2,324,089 | 84 |
| 6093. | GCATTAAAAAACATGAACACTAAA[T,C]TTAGATGGACAAAAATTGTACCTTA | 2,324,211 | 84 |
| 6094. | TAAAAGTGTTATTCGAAATCAATC[A,G]GGCAACCTCTTTCAAAATTCACCAC | 2,324,262 | 84 |
| 6095. | GTCGTCGGTTCTTGTTTTCTGTAT[T,C]TTTTtCAAGTCTAGGCTTCGGTGAT | 2,324,941 | 84 |
| 6096. | CTTCTGCCAAATTATGCAAGGCCT[T,A]TCTCAATCAGCCAGTGCCTGAAATG | 2,325,385 | 84 |
| 6097. | CTCTCGATATACAAAGGGCAGACC[A,G]TGAATGCTGCCCGGAAAGCTCTGGG | 2,325,487 | 84 |
| 6098. | TCCGAACGAGAATTAGCGTGTTAA[C,G]TTGCTGATTTGCAATAGGATAAGCT | 2,325,890 | 84 |
| 6099. | AGAAGGGGATGAATCTTGTTGTGG[C,T]CCAACGTACCAGTCACCGGTTACAA | 2,325,945 | 84 |
| 6100. | TCCGAACGAGAATTAGCGTGTTAA[C,G]TTGCTGATTTGCAATAGGATAAGCT | 2,325,945 | 84 |
| 6101. | CCAATTCAGTGAGAAACATGATTG[G,A]AGAAAGTTAAATGTGAAACAGTTTG | 2,326,544 | 84 |
| 6102. | GTGAGTGAGAATACACCAATTCAG[T,C]GAGAAACATGATTGGAGAAAGTTAA | 2,326,559 | 84 |
| 6103. | CAAAGCTCTTGGCTCTGTTTTTAA[G,T]GGTCAATTACTTGTGTTTTGAAAAG | 2,326,695 | 84 |
| 6104. | CTAGTATGTTTAAAAAAATGTGGA[T,G]GAGATATTCTTTTCCATATGCCAAT | 2,326,775 | 84 |
| 6105. | CTCAAAATAGATTTTATTTATGCA[C,T]TCGACCAATCTCCTAGTATGTTTAA | 2,326,812 | 84 |
| 6106. | ATACAATGCTCCATCCAACTGCAA[A,C]AGTGGTTTGCCCCCAAATTCAACCC | 2,327,434 | 84 |
| 6107. | CAAAGCTCTTGGCTCTGTTTTTAA[G,T]GGTCAATTACTTGTGTTTTGAAAAG | 2,327,434 | 84 |
| 6108. | GAAACAATAACAAGACTTCTCTTA[A,G]GTGCCAAATTTCATTGCTATCCTGG | 2,327,697 | 84 |
| 6109. | AAGCTAAAGACATGAGAGTGAAGA[T,C]TGAAACAATAACAAGACTTCTCTTA | 2,327,723 | 84 |
| 6110. | TCCAAACCTTTCTGGAGAATTGAA[A,G]AACATATGAAACCAAGAAACATCTA | 2,327,819 | 84 |
| 6111. | AGAAATTATTAGCACTGTGCAGGG[T,A]AATGCATGCATGATTTTAAGCAGCC | 2,327,880 | 84 |
| 6112. | TGAAGCTGCTTTAGAGTAATATGC[G,A]GTATGATGATCAATTTGTTGCCTCA | 2,327,949 | 84 |
| 6113. | TGTGTGTGTGTGTGTGTGTGTGTG[A,T]GAGAGAGAGAGAGAGAGAGATTGGA | 2,328,145 | 84 |
| 6114. | TTCTCTTCTTACAGCTCCGGTTCT[G,A]TTTAGTGCCTACTAGATTTTGTTCA | 2,328,378 | 84 |
| 6115. | CACGATGCTTAACATGTGCAGCGG[C,T]AAACTGTTTTGGTCTTATCAAGAAA | 2,328,852 | 84 |
| 6116. | GTTTGATCTGCGGTGCTTCAACCA[C,T]GATGCTTAACATGTGCAGCGGCAAA | 2,328,874 | 84 |
| 6117. | TCAGATACAGGATACAAGCTTCAT[A,T]TTGCTTGTTCATTCTTGGTTTGATC | 2,328,916 | 84 |
| 6118. | GATCGGTCACTTGCAGAATTTGAT[C,A]AGATTTATGACATTATTGGCATCCT | 2,329,102 | 84 |
| 6119. | ATTCAGATTGGATCTTCTATTCAT[C,T]CATTTCTTGCTAGAGATCGGTCACT | 2,329,141 | 84 |
| 6120. | ATTTTTGAAAGGAAGCCTGAAGAT[C,T]CAGGGTACTATATTCTGCTGTCTAA | 2,329,285 | 84 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 6121. | GGCATGGGAGTTTATCAGAAAGAT[G,T]CCAGTGAAACCAGATATTGATGTAT | 2,329,403 | 84 |
| 6122. | CAGAAGAGGCTTGCACTACTACAA[T,C]TCCATGATAGAAGACTATGGTATTC | 2,329,517 | 84 |
| 6123. | CAAGTGTGGGTGTCTAGACCTTGG[G,A]AAGAAGGTTTTTGAGCAGATGACAA | 2,329,730 | 84 |
| 6124. | TTGCATGATTTCTGTGAATAATTC[G,A]CTGATAGATATGTACTGCAAGTGTG | 2,329,772 | 84 |
| 6125. | GATGATCTGTGGAACTATGCATCA[T,C]GGAGATTGGTTGGAGGCCTTGAATC | 2,330,564 | 84 |
| 6126. | TGTTCAGAATTATCGGCTCTCGAT[C,A]AGGGCAGACAGGTCCAGGAATCGAT | 2,330,761 | 84 |
| 6127. | ACCCAGCCTCGTGTTAGGCTCGCA[A,G]CTTGTCAACATCTATGTCAGCCTTG | 2,330,996 | 84 |
| 6128. | CCTCTTCCTTCACCTGAGATCAAC[G,T]ACCAGTCCCCATGAAGCTAGAAAGC | 2,331,086 | 84 |
| 6129. | AAATTCGCCTCCAAGTCCATCTCC[C,G]ACGAGCCAGTACCAGGAATCTCATC | 2,331,167 | 84 |
| 6130. | CCTCTTCCTTCACCTGAGATCAAC[G,T]ACCAGTCCCCATGAAGCTAGAAAGC | 2,331,167 | 84 |
| 6131. | ACCCAGCCTCGTGTTAGGCTCGCA[A,G]CTTGTCAACATCTATGTCAGCCTTG | 2,331,167 | 84 |
| 6132. | TGTTCAGAATTATCGGCTCTCGAG[C,A]AGGGCAGACAGGTCCAGGAATCGAT | 2,331,167 | 84 |
| 6133. | GATGATCTGTGGAACTATGCATCA[T,C]GGAGATTGGTTGGAGGCCTTGAATC | 2,331,167 | 84 |
| 6134. | TTGCATGATTTCTGTGAATAATTC[G,A]CTGATAGATATGTACTGCAAGTGTG | 2,331,167 | 84 |
| 6135. | CAAGTGTGGGTGTCTAGACCTTGG[G,A]AAGAAGGTTTTTGAGCAGATGACAA | 2,331,167 | 84 |
| 6136. | CAGAAGAGGCTTGCACTACTACAA[T,C]TCCATGATAGAAGACTATGGTATTC | 2,331,167 | 84 |
| 6137. | GGCATGGGAGTTTATCAGAAAGAT[G,T]CCAGTGAAACCAGATATTGATGTAT | 2,331,167 | 84 |
| 6138. | ATTTTTGAAAGGAAGCCTGAAGAT[C,T]CAGGGTACTATATTCTGCTGTCTAA | 2,331,167 | 84 |
| 6139. | ATTCAGATTGGATCTTCTATTCAT[C,T]CATTTCTTGCTAGAGATCGGTCACT | 2,331,167 | 84 |
| 6140. | TCAGATACAGGATACAAGCTTCAT[A,T]TTGCTTGTTCATTCTTGGTTTGATC | 2,331,167 | 84 |
| 6141. | GTTTGATCTGCGGTGCTTACCAAC[C,T]GATGCTTAACATGTGCAGCGGCAAA | 2,331,167 | 84 |
| 6142. | CACGATGCTTAACATGTGCAGCGG[C,T]AAACTGTTTTGGTCTTATCAAGAAA | 2,331,167 | 84 |
| 6143. | TGAAGCTGCTTTAGAGTAATATGC[G,A]TGATGATGATCAATTTGTTGCCTCA | 2,331,167 | 84 |
| 6144. | AGAAATTATTAGCACTGTGCAGGG[T,A]AATGCATGCATGATTTTAAGCAGCC | 2,331,167 | 84 |
| 6145. | TTCCGCCTTCGCCACATTCGAATT[C,T]CATCGCAAATTCGCCTCCAAGTCCA | 2,331,198 | 84 |
| 6146. | tGGGGgCAAGCGACACTCTGACAA[A,T]TTGGAAGTCAATAGCCATGCCCAAC | 2,331,344 | 83 |
| 6147. | GAGGTACAGAGCCACCATTTGTTC[C,T]GGAAGCTCTCTACCATTGCAGTGCA | 2,331,417 | 83 |
| 6148. | AAGGCGCAAATGCGAGAGTAATTA[G,T]AATCTACTGGGGCTATTTATATATA | 2,331,922 | 83 |
| 6149. | ATCATTTTGTCTGCAATATGTTTG[A,G]CAGAAGAACAAATCATTTGCAGGCC | 2,332,543 | 83 |
| 6150. | ATATGATTGTTACAGTGTCAGGCT[T,G]GCCAGCCCTGGCTTTGGATTGGGCC | 2,332,885 | 83 |
| 6151. | TGGGTAACGTGCTTACTCTCTGCT[T,C]GAGCCACTTGTATAAAAATCATATA | 2,333,000 | 83 |
| 6152. | AGTTGAGGAAGCCTTGGGTAACGT[G,A]CTTCATCTCTGCTTGAGCCACTTGT | 2,333,014 | 83 |
| 6153. | CTTGGATTCATAAATTCAATTTCT[T,G]TCATCATTGTACATCAGGTTTCTGA | 2,333,169 | 83 |
| 6154. | GATGCTGAATCGACGAAGAAGGTA[G,A]TGTGGGAGAAGTTTCTGTCATGACT | 2,333,237 | 83 |
| 6155. | GAAGACTTGGGTCTCCATGATTTC[A,G]GTATTTGTGCTTAACATCCTTTGGA | 2,333,488 | 83 |
| 6156. | TGAAGACTTGGGTCTCCATGATTT[C,T]AGTATTTGTGCTTAACATCCTTTGG | 2,333,489 | 83 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 6157. | CTTATTCAGTTGTATTAAATACAA[T,C]TTATTCATGCTGTATAATTTAACTT | 2,333,630 | 83 |
| 6158. | CAAATTTCATATCCTTTTTCTCTA[A,T]GAGGTCCATTTTATGCCATGGTTGT | 2,333,861 | 83 |
| 6159. | TTGGGAAACCAACAGGCCTGACAT[A,G]TACTGTATGTCTACTGCTTTATAAG | 2,333,973 | 83 |
| 6160. | ATTTTAGACAGGAACTGGTACAAT[G,T]CTAAAGTTACAATTCTAAGTTTCAC | 2,334,069 | 83 |
| 6161. | TGATCTTTGTCTGTTATTTTGATG[G,A]CAATGCATTTGTTTTGTGGTCTGTT | 2,334,366 | 83 |
| 6162. | GAAGATCTTCTCATCTTAAGGCCA[T,A]TGCTTCAGGTGCATACCAAATCTTA | 2,334,680 | 83 |
| 6163. | ATGCAATTTGTGATCTATATATGC[G,A]TATAAAGTATCATCAGTGGTAGTGT | 2,335,003 | 83 |
| 6164. | GGTTAATCCTCAGGTTATTTTTAG[A,T]ATTAAACCAGAAATTCTTCCATGCA | 2,335,048 | 83 |
| 6165. | CAGGCTCTTTTTTCTCTCATTTCT[A,T]TGTTCTTCCCTAGACTTTCTGAAAG | 2,335,317 | 83 |
| 6166. | GTAGAAGCATAATTTCTTTGTGGC[T,C]GACCAAGCCTCAAAAGGAGTAATAG | 2,335,421 | 83 |
| 6167. | CAGCCAAGGGCGCCTCGCTTGAGC[A,G]CCTAGGCGCGCCTAGACGAGCACCT | 2,335,645 | 83 |
| 6168. | AGGAGGCTGAGGTGCTTTCAGCCA[A,T]GGGCGCCTCGCTTGAGCACCTAGGC | 2,335,663 | 83 |
| 6169. | AAGCGAGCGCTTAGGCGGTAGAGG[C,T]GCTTGTCTGGAGGAGGCTGAGGTGC | 2,335,698 | 83 |
| 6170. | AAGGCGAGAGCCTTGCGCCTTGCT[C,T]CAAGCGAGCGCTTAGGCGGTAGAGG | 2,335,724 | 83 |
| 6171. | GCCAAAGGCGAGAGCCTTGCGCCT[T,C]GCTCCAAGCGAGCGCTTAGGCGGTA | 2,335,728 | 83 |
| 6172. | TAAAACCTATTTGTTTCTTAATTT[C,T]TTTTAATAAATTACTTAAGTACCTT | 2,335,898 | 83 |
| 6173. | CTGTCAACTTCAATGGAGGGAAGG[G,A]AACTACTCTAGCCGTCCAAAGTCCA | 2,336,009 | 83 |
| 6174. | GAAGAAGGAGAGGAGATTAAGAGA[G,A]GGAGAGGAGAAATAAATTGTGAAA | 2,336,108 | 83 |
| 6175. | AAGACAGCCTTCTTTTCGTACTAA[C,A]ATGTCCTCTGCCCTTCTGTGTTGTA | 2,336,108 | 83 |
| 6176. | TGCTAGCATTGGTCGTTGTACCCT[T,C]TGCTGCTGCCATTGTAAAACTAGTG | 2,336,424 | 83 |
| 6177. | TGACAAAATCATCAAAGTCTGGCA[C,T]TTTATGATAATTCTCTTTGTGGTTC | 2,336,682 | 83 |
| 6178. | ATGCCATGGCTTCTTGACATTATC[C,T]ATCCCTTTATTCGTGGCTGAACCAG | 2,336,798 | 83 |
| 6179. | GGTAGAACAGACAAGCAATATATT[G,T]ACAAGCTTCTTCTTTTtTTCTTCTT | 2,336,950 | 83 |
| 6180. | GACCAACCTGCATACCTTAATTCC[A,G]TCCAGCTACTTGGATGAGTTTTCTC | 2,336,950 | 83 |
| 6181. | GAACCATCCAAATCTCGATCAAGA[A,T]AGGTATGTGGTGGATAATAGGATGA | 2,336,950 | 83 |
| 6182. | TCACCAGAAAATTCATTAAACTTC[G,A]ATCCCTCTGATTAGTCCATCCATCT | 2,337,202 | 83 |
| 6183. | CATCAATAGATTTTACGAACATTG[A,T]TCCAGCAGGGTAGTTCACCAGAAAA | 2,337,262 | 83 |
| 6184. | CAGTTGTAACATATGATGAAGCAT[C,T]AATAGATTTTACGAACATTGATCCA | 2,337,262 | 83 |
| 6185. | CATTTTCTCTCCAGTTGTAACATA[T,C]GATGAAGCATCAATAGATTTTACGA | 2,337,273 | 83 |
| 6186. | CCATGATGAAATTAGTTGCATTAT[C,T]GGTAATTACTTGGACAACATTTGCC | 2,337,361 | 83 |
| 6187. | AGTCATACCAGCCATGATGAAATT[A,T]GTTGCATTATCGGTAATTACTTGGA | 2,337,372 | 83 |
| 6188. | ATTTTAAACAAATGCAAAAACAAT[T,A]TGCAATGTAGAATTAGAAATTAGAA | 2,337,495 | 83 |
| 6189. | TTCGTTTAACTTGTGGAATCTCCC[C,T]AATATCTTCCAACATTAGATCTATG | 2,337,605 | 83 |
| 6190. | CCTCATAATGTTTAGAGCACCAAC[G,A]TGGTTGTAAAATAAAACCGGTAAG | 2,337,675 | 83 |
| 6191. | GTGAACTCCCTCATAATGTTTAGA[G,A]CACCAACGTGGTTGTAAAAATAAAA | 2,337,683 | 83 |
| 6192. | TAATGTGCAAAATATGATTTTTCC[A,C]GCCCTAACTAAGTCCCTCCTTTTTG | 2,337,732 | 83 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 6193. | CGGACAATTGATTTGATTATAGTT[G,A]GTAAATAAGATGTTATCGGTGATGA | 2,337,732 | 83 |
| 6194. | GATGACCATGTCCGCACTTGATCT[G,T]AGCCAAAAGGCTGAGAAAGGTATAC | 2,337,732 | 83 |
| 6195. | GTGAACTCCCTCATAATGTTTAGA[G,A]CACCAACGTGGTTGTAAAAATAAAA | 2,337,732 | 83 |
| 6196. | TCTTTGTGTGGCTCTCGTGGACAC[C,A]AAATATTTTTATATATGTTTGCACG | 2,337,732 | 83 |
| 6197. | GCCAAGTGGTGATGTGTTTGGTC[C,T]GCGGTCACCTTGCACGATGTATCAA | 2,337,732 | 83 |
| 6198. | CCTCATAATGTTTAGAGCACCAAC[G,A]TGGTTGTAAAAATAAAACCGGTAAG | 2,337,732 | 83 |
| 6199. | AAAGTAAGATATAATGTGCAAAAT[A,C]TGATTTTTCCAGCCCTAACTAAGTC | 2,337,743 | 83 |
| 6200. | CCTGTTCAAACACACTCCAATTAC[G,A]CTCACAACCAGATGCACACCATTCC | 2,337,921 | 83 |
| 6201. | GTACCAATCAATCATTTATCAAAA[T,C]TTGTTTAAAAATATAATATTACTAT | 2,338,016 | 83 |
| 6202. | CTTTAAGCTTTTGATTGTACTTGA[C,T]GTACACTAAATCACTAAGCTTCTTT | 2,338,104 | 83 |
| 6203. | CCTTAACATCCATAGAATTGACTC[C,T]TTGCATGCCAGACTTTCCAATCAAC | 2,338,221 | 83 |
| 6204. | ATGAAATAATGAGGTAGGCGAAGA[C,T]CGATATAACCGCCATTATACCGTTA | 2,338,221 | 83 |
| 6205. | CATCTTTGGTCTGTGAAAGGCTTC[A,G]CCAATTATGTATGCATACCCTCACG | 2,338,221 | 83 |
| 6206. | TATGTATGCATACCCTCACGTGAA[A,G]CCATCATGTGCCCCTTGTATGTATG | 2,338,221 | 83 |
| 6207. | TATTTTTCCTTCCTTCTCTAACAC[T,C]TGCTGCCCTAGCTACTGCACCCCAT | 2,338,305 | 83 |
| 6208. | TAAGTTTGGTGGCTTTGAATGTGA[A,G]GTTGAAGCTGCTGTTGATCTTGATC | 2,338,370 | 83 |
| 6209. | TCAATCTCTTCTTCTGAACTAGAA[C,T]GAATCTCTTCATGATTTAAGTTTGG | 2,338,411 | 83 |
| 6210. | CATACCCAAAAGACTAAAACTTTT[C,T]TGAGTTTTCCTGTTTTCTCCATTACT | 2,338,587 | 83 |
| 6211. | ATTGTGTGTGTGTGTGACAAAA[A,C]AGATTAGCAATGCAATGTCTAGAAC | 2,338,587 | 83 |
| 6212. | AAAAAGTAAATAATAAGACACAAG[C,T]AAATACAAAAAAATTTATAGTGATT | 2,338,587 | 83 |
| 6213. | AACACCATACCCAAAAGACTAAAA[C,T]TTTTTCTGAGTTTTCTGTTTTCTCCA | 2,338,592 | 83 |
| 6214. | GGAAAATAGAAAATAAATATAGT[C,T]TATTCTAAACTAAGTCTTAATTACA | 2,338,700 | 83 |
| 6215. | GGTACTAGGCGCTGAAAAAGCGAA[A,C]ACCTGATTGAAGTCAGATGCCATGT | 2,338,755 | 83 |
| 6216. | TCAAAAGTATTCTATTTATATTTC[T,G]ATAGGTCAAGAATGTTTGGTTTGCT | 2,339,344 | 83 |
| 6217. | TTTTCATCACCTTGGTGATTGCTT[T,C]TGATCCTATTGATGTTGCAAACATG | 2,339,476 | 83 |
| 6218. | TGGACCGCTATGGGAGGTCTAATC[A,G]TGGATCTATTTAAGTTGGGGCTAGT | 2,339,532 | 83 |
| 6219. | CCAACACGCCCCACTGAACTGGCAG[T,G]GCAATTCATCAAAGTTATCACACTG | 2,339,628 | 83 |
| 6220. | GATATGGTTGTAAACTTTGCAATA[T,A]GACCCCCTAATTTCTGAGGCAGGCC | 2,339,838 | 83 |
| 6221. | AGCCATACATCTCCTAGATAACAG[C,T]ATGAGATATGGTTGTAAACTTTGCA | 2,339,867 | 83 |
| 6222. | GTATGATGATTTTCTTAACAAGA[T,C]GGGATTTATGATTTGACCTTTTCTT | 2,339,929 | 83 |
| 6223. | AGTACTGTGATGGCTTATGTTGGAP[G,A]TATCGGCTACATGCCAACAAAATTA | 2,340,368 | 83 |
| 6224. | CTATCTATCTTCTGGTGATACACT[G,A]GTGGAGAAATATACTGAGTTATTGT | 2,340,456 | 83 |
| 6225. | TGCAAAAATTTTATCCATAATAAT[T,G]TAAATTCAATTTTAACTGGCTAACT | 2,340,506 | 83 |
| 6226. | TGGTGAAGAACTTATTATTGGTTT[T,C]TCAATGTGAGATATGACTCCAGCCA | 2,340,622 | 83 |
| 6227. | ACCCCTTAAAATGGTGAAGAACTTA[T,C]TATTGGTTTTTCAATGTGAGATATG | 2,340,753 | 83 |
| 6228. | GTTTTTTAATATATCGGCTACCAT[T,C]GTAGCAGCTATGTTCTATGTTTTTG | 2,340,753 | 83 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 6229. | TCTGCGAGAAGATTGATTTCATTA[A,T]CAAGCAATTTGTTTTTAATATATC | 2,340,788 | 83 |
| 6230. | ATAGTTCTTGATGTGTTCTCTTCC[G,A]CAAGTTGTATTTCAGAAGTGCTTGT | 2,340,942 | 83 |
| 6231. | TCTGCGAGAAGATTGATTTCATTA[A,T]CAAGCAATTTGTTTTTtAATATATC | 2,340,942 | 83 |
| 6232. | GTTTTTtAATATATCGGCTACCAT[T,C]GTAGCAGCTATGTTCTATGTTTTTG | 2,340,942 | 83 |
| 6233. | ACCCTTAAAATGGTGAAGAACTTA[T,C]TATTGGTTTTTCAATGTGAGATATG | 2,340,942 | 83 |
| 6234. | TGGTGAAGAACTTATTATTGGTTT[T,C]TCAATGTGAGATATGACTCCAGCCA | 2,340,942 | 83 |
| 6235. | TGCAAAAATTTTATCCATAATAAT[T,G]TAAATTCAATTTTAACTGGCTAACT | 2,340,942 | 83 |
| 6236. | CTATCTATCTTCTGGTGATACACT[G,A]GTGGAGAAATATACTGAGTTATTGT | 2,340,942 | 83 |
| 6237. | AGTACTGTGATGGCTTATGTTGGA[G,A]TATCGGCTACATGCCAACAAAATTA | 2,340,942 | 83 |
| 6238. | GTGAACAATTCAATAAAATCATGA[T,G]AAATAAAATCTAAAAATATCTGATC | 2,340,942 | 83 |
| 6239. | GTCTGGAATTACATAGTTCTTGAT[G,A]TGTTCTCTTCCGCAAGTTGTATTTC | 2,340,954 | 83 |
| 6240. | GTAGCCTCGGCCTCTGCGTCGTCC[G,A]ATCCTCCGAGGCCAGTGCTTTACGA | 2,341,157 | 83 |
| 6241. | GTCTGGAATTACATAGTTCTTGAT[G,A]TGTTCTCTTCCGCAAGTTGTATTTC | 2,341,157 | 83 |
| 6242. | GTAGTTCGTCTCCTCCTCTTCCCT[T,C]TCCTTCGTCGGCGGCGGTGGAGGAA | 2,341,340 | 83 |
| 6243. | GATGTAATAGATCTTATTGCCAAA[C,T]CTCGTCCAAGTGATCCATGAAAGGT | 2,342,321 | 83 |
| 6244. | GGCTTTTGAGTTTCATTTTATAA[T,C]TAAGTTTTGGATGTAATAGATCTTA | 2,342,355 | 83 |
| 6245. | AAATAGATCCCTCTTATAGTTCAG[G,A]CTAAATTTTTAAAAATAGAAGATA | 2,342,488 | 83 |
| 6246. | GAATTTCTTTCAACCATCTTAATA[T,C]AGAGCTCTCAAAATAATAAATAAAT | 2,342,773 | 83 |
| 6247. | AAGTCAGCAAATTTCTAGATATCA[T,C]GGAATGTGAAAAGTCACCAAGGAAA | 2,343,250 | 83 |
| 6248. | TCTTTTGGAGTTGATTATGAAGTC[A,G]GCAAATTCTAGATATCATGGAATG | 2,343,269 | 83 |
| 6249. | TCTCTCATACCTGGTGCCAAGTGA[C,A]ATTTTCATTTAAGCTGTAGAGCTGA | 2,343,350 | 83 |
| 6250. | TAGGCTATATAAAATTATATTAAC[G,A]AGTTGTATTTTAGCATTCTAGGTGA | 2,343,425 | 83 |
| 6251. | AGTTCCTTAGGCTATATAAAATTA[T,G]ATTAACGAGTTGTATTTTAGCATTC | 2,343,432 | 83 |
| 6252. | GCTTGGTCAACTCCAAGTAATGAA[T,C]CTCAGATATATCACCCTGATTTGGA | 2,343,558 | 83 |
| 6253. | AATGGAGGGCCTGCCATAAAACCT[G,A]CAAGGCTATGTGGCAGGAGGGAAGG | 2,343,607 | 83 |
| 6254. | AGTTCCTTAGGCTATATAAAATTA[T,G]ATTAACGAGTTGTATTTTAGCATTC | 2,343,607 | 83 |
| 6255. | TAGGCTATATAAAATTATATTAAC[G,A]AGTTGTATTTTAGCATTCTAGGTGA | 2,343,607 | 83 |
| 6256. | TCTCTCATACCTGGTGCCAAGTGA[C,A]ATTTTCATTTAAGCTGTAGASCTGA | 2,343,607 | 83 |
| 6257. | TCTTTTGGAGTTGATTATGAAGTC[A,G]GCAAATTCTAGATATCATGGAATG | 2,343,607 | 83 |
| 6258. | AAGTCAGCAAATTTCTAGATATCA[T,C]GGAATGTGAAAAGTCACCAAGGAAA | 2,343,607 | 83 |
| 6259. | GAATTTCTTTCAACCATCTTAATA[T,C]AGAGCTCTCAAAATAATAAATAAAT | 2,343,607 | 83 |
| 6260. | AAATAGATCCCTCTTATAGTTCAG[G,A]CTAAATTTTTAAAAATAGAAGATA | 2,343,607 | 83 |
| 6261. | GGCTTTTGAGTTTCATTTATAA[T,C]TAAGTTTTGGATGTAATAGATCTTA | 2,343,607 | 83 |
| 6262. | CAACATCAATCTTCAAAATGTTGC[G,T]GGATTACAGCCAATGCATCGCACTT | 2,343,658 | 83 |
| 6263. | TAGGACAAAAAGTTAATTCAGGGA[C,T]TAGGATTATGCCTGGGAATATGAAA | 2,344,033 | 83 |
| 6264. | CAACATCAATCTTCAAAATGTTGC[G,T]GGATTACAGCCAATGCATGGCACTT | 2,344,073 | 83 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 6265. | AGGCAATCTTCACCCTCCATTAAT[G,A]CCATATGGATATATTTAGGACAAAA | 2,344,073 | 83 |
| 6266. | GATAACCTTCTGTTAGATTATTGT[A,C]GGTTTCTTTTTCCtttttttttttt | 2,344,132 | 83 |
| 6267. | TTTGCAAACCATGGTCATATGGCC[G,A]CCATTAAATCAAAACTCAATAATTT | 2,344,339 | 83 |
| 6268. | TAATCTATCTCTTTGAATCGGACT[G,T]GCACCAGAAAGACTTCGAAATTTGA | 2,344,466 | 83 |
| 6269. | TTTAAAAGAAAAGAAAATAGGAGC[G,A]TGATTTTGACATTCAAATCATGATG | 2,344,609 | 83 |
| 6270. | TGTTTTCTACACATTCATGCCATTCT[C,G]ATGTGCATCATGTGGATATATACAT | 2,344,754 | 83 |
| 6271. | ATGGATAATGTACTAAATAATTTT[A,C]TTTCTCATAATGTTTAGGTGATGAA | 2,344,938 | 83 |
| 6272. | TCTACTCTACCTTTGAAATAGGGC[T,C]ATATGGATAATGTACTAAATAATTT | 2,344,965 | 83 |
| 6273. | TTCCTTTTCCTTTTCAAGGAAATA[G,T]GATGGGCATAGCCTGCTCGAACTC | 2,351,380 | 83 |
| 6274. | TAGAACTCGTTTTTGTAAAGTTCT[G,A]CCACTCATTÅATAATGATTTATTACC | 2,351,468 | 83 |
| 6275. | TTTATGTGCCTTACCATATTAATGT[C,G]TTAATTTCTTAGTATTTTGTTTTGA | 2,351,533 | 83 |
| 6276. | TTATTAGCATGAAGAGGGATATTG[T,C]GAAAGGCCCTCTTTCCCAAGATTCA | 2,351,626 | 83 |
| 6277. | ATCTTCTTTATGCTTTGACCCTGG[C,T]GACAATATCTGATAAAACTAGTCTC | 2,352,077 | 83 |
| 6278. | TCAGAGTAGCAGCCAGCAGGCTGC[A,T]GTTGTGTCGTATGATGGACTCAAGC | 2,352,182 | 83 |
| 6279. | TTTGAAGCATTACCTACTTCAGAT[G,A]GCCAAAATACTCTTTTATTTTtCTT | 2,352,448 | 83 |
| 6280. | AAAAGGCTAATCAATCACAGACAA[A,T]TGAATTTGCCTGCTGTTCCCTCTTC | 2,352,596 | 83 |
| 6281. | CATGGCCAATCATGTCATGCCACT[A,T]GTGCCCACCACACATGCACAGCAAG | 2,352,699 | 83 |
| 6282. | TATGGTCATCACAAGCAGATTCCA[G,A]CCGACTTGATTTTGTTACTTATCCA | 2,352,919 | 83 |
| 6283. | AAAATCCTGCACTTCCTCTCTAAC[T,C]AGATCTTCCACCATATGGTCATCAC | 2,352,957 | 83 |
| 6284. | CAAATTTTAGTTTGTTCCATTAAA[G,A]CCCTCAGTGTGATGAGAAGTAGTTTC | 2,353,008 | 83 |
| 6285. | CATTTCATTGAGAGATTGAATTAT[T,G]AAAATGAACAAGACTAACGCCAGCC | 2,353,134 | 83 |
| 6286. | CTTCATTTCATTGAGAGATTGAAT[T,C]ATTAAAATGAACAAGACTAACGCCA | 2,353,137 | 83 |
| 6287. | GACTTCTCAAATGCAGTAATGTAG[C,G]CAATTTTTATGGTTTCTGACCATGC | 2,353,316 | 83 |
| 6288. | GAGATCGGAAATGATCGATTACTT[G,T]AGCTATGTTTTTCGAATTGAAATTC | 2,353,405 | 83 |
| 6289. | TTTTTCATTCACCTTCCTCTTCTC[A,C]CTCGTATCTACATTTGCAACCTCAA | 2,353,570 | 83 |
| 6290. | GTATGTCGTAGTTGTGATTATATC[G,T]AAATGGATTTAGATCCTTAGCCTCA | 2,356,870 | 83 |
| 6291. | GAGCAAATCCCCAGATCAAGTGCA[C,C]CATAAGGTTGACACATCCCAGTAGT | 2,357,591 | 83 |
| 6292. | ATGCTAGGAGCAAATCCCCAGATC[A,G]AGTGCAGCATAAGGTTGACACATCC | 2,357,598 | 83 |
| 6293. | AGGGCCCCTGGTTGATCACCAACT[A,T]GGTGCTAGTGCATGAACCCTCATGG | 2,358,285 | 83 |
| 6294. | CAGTCAAACTAATGAAAGCTGGAT[T,A]CACACCAATTGTATCTGGCTATAAT | 2,360,884 | 83 |
| 6295. | GTGGACTTGGGTGCTAGCATGCAG[G,A]AGCAACCACTCAAAACAATCTAGAA | 2,361,302 | 83 |
| 6296. | ATATGCCTATTTGATTAAATATAC[C,T]TTAGATGTCAAAAGGGGAGCAAGT | 2,361,358 | 83 |
| 6297. | GAAAAGAAACAATTCATCTATAT[T,G]GCATATACACATAGTTTTCATTCAG | 2,361,499 | 83 |
| 6298. | TCTTAGACAATTGATAGTCAAAAT[T,C]TTGAAAAAGAAACAATTCATCTATA | 2,361,528 | 83 |
| 6299. | ATTTCACCATTTACCAATTGCATA[C,T]GAAATCTAGGAAAATTAAAATAATG | 2,361,933 | 83 |
| 6300. | ATTTGATCCAAGTTATGGAGTTTT[T,G]GTCACAAAATTAAAGAAATATGCCA | 2,362,076 | 83 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 6301. | CCCACCATATTTGATCCAAGTTAT[G,A]GAGTTTTTGTCACAAAATTAAAGAA | 2,362,084 | 83 |
| 6302. | AGGTTTAGCCAGTCCTTAGTGGAT[G,C]ACCATGAATGTTTGAAGCTCAGTT | 2,362,149 | 83 |
| 6303. | TGTCTAAAATCTTGAAGGACCTAG[G,A]TTTAGCCAGTCCTTAGTGGATGACC | 2,362,171 | 83 |
| 6304. | AGGGAATGAAAGTAAGAGAGAGAG[G,A]GAGAGAGAGAGATTCAAGCTAGCTG | 2,362,501 | 83 |
| 6305. | AATAGATAATTGGTTCAACTTCTT[A,G]TCAAGAGGATATGTCCTCCATGGGT | 2,362,759 | 83 |
| 6306. | TCTAAAGTCTAAACTTCTCTTACC[A,G]ATAAAGGTGAACCAAAATACCATGT | 2,362,908 | 83 |
| 6307. | ATTGGAATATTCGTAAAGAAAGAA[T,G]GCAACTGGCCAGTAACTGAAGAGAC | 2,362,994 | 83 |
| 6308. | AGTTCTCTCCATACATCTTCTACT[C,T]TTGGCTCCACATAGTATTACTGATA | 2,363,134 | 83 |
| 6309. | AAAATATATCTAGAATCTAGGCAC[C,A]TAAAGTTCTCTCCATACATCTTCTA | 2,363,162 | 83 |
| 6310. | TCTATTTATATATATAGTCTTAGC[A,G]GAAATGAATGATCTCTCAAAATGAA | 2,377,225 | 83 |
| 6311. | ATTTTTAGTGATATATATTATGAC[G,A]AAAAGTGGATCTTTGAGTTAGATGC | 2,377,348 | 83 |
| 6312. | TTTTGATTTCTAGATATTTTTAGT[G,A]ATATATATTATGACGAAAAGTGGAT | 2,377,363 | 83 |
| 6313. | AGATTATTAAAACACTTGATTTTT[G,T]ATTTCTAGATATTTTTAGTGATATA | 2,377,383 | 83 |
| 6314. | ATGATCTCATATTATCTTAACCCT[T,C]CATTTTTGCACTCACTAGATGCATG | 2,377,472 | 83 |
| 6315. | TAACAAAATATGATCTCATATTAT[C,G]TTAACCCTTCATTTTTGCACTCACT | 2,377,481 | 83 |
| 6316. | ATTAATTAGTAACCCATATATACC[G,A]TATCGGCACAAAAAATGAAATAGTT | 2,377,659 | 83 |
| 6317. | ATACTGAAAGGGGCAAAATCCTTC[T,C]TATGTACATGAGATAGCTTTGCTCC | 2,377,836 | 83 |
| 6318. | CACATGTTTCGGAGCCGGGCACC[A,G]AGGTTTTATCCATAACATATGAATC | 2,377,941 | 83 |
| 6319. | GAGAGAGAGCTTTTGTGAAGAAAA[T,A]TTTTTTGTGAGGGAGAGATTGGGTG | 2,378,452 | 83 |
| 6320. | AGCATGCACAGGTACGGCCCATGC[G,A]ACTTTCAATGGCCCATCGATGGTCC | 2,378,901 | 83 |
| 6321. | GGTGTGACAAGTTGGGACATCTAG[C,T]CAGAGATTGCTCTCAACTCAGGGAT | 2,379,978 | 83 |
| 6322. | AGGAGATGGTAGACAGAGCGATAG[G,A]AGATCACGATGGGGGGTTCAGGTCC | 2,380,002 | 83 |
| 6323. | AGTAGGAGATGGTAGACAGAGCGA[T,C]AGGAGATCACGATGGGGGGTTCAGG | 2,380,065 | 83 |
| 6324. | TtTTTTCTTTCTGCTGCGATGCGT[G,T]GTATCAAAAAAGTCTTGTGGAGGTG | 2,380,821 | 83 |
| 6325. | TTTTATTTTtTTTTCTTTCTGCTG[C,T]GATGCGTGGTATCAAAAAAGTCTTG | 2,380,829 | 83 |
| 6326. | ACAGGTATGGTGGTTCTGTAGAGA[C,T]CTGAAATCGTGGAGTAGAGGATAGC | 2,381,129 | 83 |
| 6327. | AACTCATCCTGTGGCAACAGAGAC[A,G]GGTATGGTGGTTCTGTAGAGACCTG | 2,381,151 | 83 |
| 6328. | GGATGTTTTGGGCTGATTTTTCAC[A,G]GTCTACAAAGATTTTCATGGATCGA | 2,381,321 | 83 |
| 6329. | TCCATCATGGATCGAAGGATGTTT[T,C]GGGCTGATTTTTCACAGTCTACAAA | 2,381,337 | 83 |
| 6330. | GGGTGGGCATTTTTTCTTAGTTTC[A,G]CACAGTCCATCATGGATCGAAGGAT | 2,381,367 | 83 |
| 6331. | AATGAGCCCAAGATCAGTCCAAAC[A,G]GAGATCGGATGAAAAAGATATGCTA | 2,381,651 | 83 |
| 6332. | GAATAGGATTGACTACATTTGTAA[T,C]AGATTGGATATGATTAATATCTATG | 2,383,756 | 83 |
| 6333. | ACTAAGGCTCTAAACCGGAATAGG[A,G]TTGACTACATTTGTAATAGATTGGA | 2,383,773 | 83 |
| 6334. | ATTAAAGGATAAAGTATATTGAAG[T,C]TGATTGTCACTTTGTTCGTGAGAAG | 2,383,886 | 83 |
| 6335. | GATGAGCTTGTTTTCAAAAGTACT[C,G]TGCCTATGAGACTGTGATGTGATAA | 2,383,974 | 83 |
| 6336. | TTTATATTTTTTCCTCGAACTACT[C,T]ACTGGGAGGCAGTTCTGTATATATT | 2,384,286 | 83 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 6337. | CATAAAGATACAGAAAGTTGATCG[G,A]TAAGCTTAATTATCTTACAGTCACT | 2,384,375 | 83 |
| 6338. | ATTGTGCATGTGGATGATATTGTA[A,G]CTAGTCACAGGAAGTGATGATACTG | 2,384,662 | 83 |
| 6339. | CTTATTTAGATGGGTCAATTCCAT[T,C]ATCTACATTGTATTTCAACTTTTTA | 2,385,909 | 83 |
| 6340. | TTTTACTGCCAATCTAAAAAAaT[T,C]ATCTACATTGTATTTCAACTTTTTA | 2,386,027 | 83 |
| 6341. | TTCAATTAAATTTGATCCAAATCT[T,C]AATGCTCAATCAAATTTAATTAATT | 2,386,427 | 83 |
| 6342. | TTTAGAAACTACCTAATTAGGATC[A,G]TATGACATAAATAAATGCAACATCT | 2,387,678 | 83 |
| 6343. | TTATAAATTATCATACAATCAACT[G,A]AAAATTAATTTCAAATCTAACATAC | 2,388,111 | 83 |
| 6344. | TGGACTGATATAGATTGGGATTCG[G,A]AAAATTAATTTCAAATCTAACATAC | 2,388,171 | 83 |
| 6345. | ATCTAACAATCGAATGATCAGGCC[T,C]GAGTGTAGCTTGGCCAACCTAACCA | 2,389,338 | 83 |
| 6346. | CCATCAATTTAACAATATCTAATA[G,A]TGATCGGAGCGATAAAGTGGTGGCC | 2,389,739 | 83 |
| 6347. | TGTAGGCTTTGTCATTCTATAATG[G,A]GTAAGAAATGAGATGTAGGATTTTG | 2,390,225 | 83 |
| 6348. | TTGAAACAGATTTTTCATCTCCAA[T,C]ATTAAGAAATTTTTCGCCTTCTTCA | 2,390,715 | 83 |
| 6349. | CACAATCATTGACTTCGAAGATTT[T,C]CTCTTGAGTCAATCGATTTATTCTG | 2,391,078 | 83 |
| 6350. | GGTATTAGTTTCTTCCTCAAGAAA[C,T]TTCTTTTTCAAAAGACTGTCCTAT | 2,391,861 | 83 |
| 6351. | GATTTGATCTAATCAAATCCGACT[C,T]TATAGATTTACTATATTATGCCGGT | 2,391,949 | 83 |
| 6352. | TCTTCATCCTAAATATGTAGGATG[C,A]TTCTTCTAAATTCTTCATAGAGAAC | 2,392,780 | 83 |
| 6353. | AGTTACCATGATGATCTCAGATCG[A,G]AGAAACACTTATACCCATATCCTTC | 2,394,103 | 83 |
| 6354. | CAATCTAATCACTAATCAATCCTT[C,T]AATAATTCATCAACTATTAGTAAAT | 2,394,708 | 83 |
| 6355. | CTCATTCAAATTCAAAGGGAATCA[G,A]AAAGTGAGTGTCAATCCTCTTCTGG | 2,395,119 | 83 |
| 6356. | TCCCTCTCAGAAATGATTTTCCAC[G,A]ATAAAGACTCTCTTTTTGTCGCACA | 2,395,459 | 83 |
| 6357. | GGGAGTGCTAGCTCGCACGAAAGA[C,T]ACTGGATGGTTGATTTATGCTCTTT | 2,395,726 | 83 |
| 6358. | GAAAGAAAAATCGATGGTTCAAAG[C,T]ATGCATTTTCAAAATTTTTTAGCGA | 2,396,107 | 83 |
| 6359. | TGGGGATCTTGTTCCATCGAGTCT[A,G]AGTCTGATTTTAGATGCTTTATTAC | 2,397,108 | 83 |
| 6360. | TTTTGAAATTATTCATTCTAATGT[C,T]TGGGGATCTTGTTCCATCGAGTCTA | 2,397,133 | 83 |
| 6361. | TAGAGGTCATGAGTCCAAAAGGCT[A,G]TACACTCTTGAGATTATGTCTGATT | 2,397,382 | 83 |
| 6362. | TATGTTAGTAAGATTACTCATGCT[G,C]TCAACTGTAATGTTCACTTCTTTCC | 2,397,477 | 83 |
| 6363. | TACTTGCCCCATGCCTTCTCTTTT[C,T]TTAAGTTCTGTTCTGTACTTATCTC | 2,397,547 | 83 |
| 6364. | CTATTACTTGTCTCACCTCTTCCT[C,T]ATGCAATTGGGTCATTGATTCAGGT | 2,397,713 | 83 |
| 6365. | TCTTTATTCGGTCAGGTAAATCTA[T,C]TACTTGTCTCACCTCTTCCTCATGC | 2,397,734 | 83 |
| 6366. | GATCGACTTTTAAGATCCCTCTTT[T,C]CTCCTTCTGTAGTGCATGACCCTTT | 2,398,118 | 83 |
| 6367. | GAGATCAATTATGGTATACATTAT[G,A]GTGTATATTTCTGTTTAAGAAATAT | 2,398,523 | 83 |
| 6368. | TAATCTTTTCTTCTCAAATCACCC[C,T]ACAACCCACTGATGAGATATCTATC | 2,398,635 | 83 |
| 6369. | ATAGATTTTATAACTTAGATTATT[A,G]AGAAAATAGTCTCACATTATTTTAA | 2,399,082 | 83 |
| 6370. | CTTCGTACATCAAAGCATACAACA[G,T]CATATCTCTCCCTGCCTAATCAATC | 2,399,204 | 83 |
| 6371. | TTAAGAGGATGTATCGAAGCCTTC[G,A]TACATCAAAGCATACAACAGCATAT | 2,399,224 | 83 |
| 6372. | GAATATGTGGAAATGATCTAGACC[A,T]CAGAGTAAGAATGTAAACTAATTTC | 2,399,620 | 83 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 6373. | CATCCAATTTCAGAATCCAAATTG[T,C]GGAATATGTGGAAATGATCTAGACC | 2,399,646 | 83 |
| 6374. | AGGACCCATGCACACACATATATA[C,T]AGTACAGGCATAAATACATACATAT | 2,399,752 | 83 |
| 6375. | TTATTAAAATAAACTCTGGTCGAT[A,G]ATACCCCCAACCTCTTTAGTTATAT | 2,399,805 | 83 |
| 6376. | GCAAGTGCTAAATCAAAAAAGTGA[T,G]TTTATTTATTAAAATAAACTCTCCT | 2,399,835 | 83 |
| 6377. | TAATCAATCTTGCTAAATATCACT[G,A]GCTCTTGGCATGTACAATGTGGCTA | 2,399,974 | 83 |
| 6378. | GATCTCTTCTTGTAATTTTTTTTt[C,T]ATAGTGAAGCTTGCATGCCCCATAG | 2,400,400 | 83 |
| 6379. | GGCGGCAGAGGGCCAATAGAAATC[G,T]ATGGTGGCACAGCTAGGCCGGGTAG | 2,401,004 | 83 |
| 6380. | TGGCCTGACTTGACTTTCATATTT[G,A]TCCATAATTGATCAATAGGTGATTG | 2,401,288 | 83 |
| 6381. | TTAGGAGCCAGAAGGAGCCCAGAA[C,T]GAGGTGGAGCTCTAGATAGAGGTGG | 2,401,471 | 83 |
| 6382. | AATTTTAGATTCTGCATGCACCTA[G,C]CATGTATGTTATAAAAAAGAGCAGT | 2,401,830 | 83 |
| 6383. | ATAATGAAGCTTGCATGCCCCATA[G,A]AGGCGAGCTTTTTGACTGATCCACG | 2,402,895 | 83 |
| 6384. | GAGTATGAGAAAAACTCGAAAATA[A,G]ATGGCACAGCCCACAGAGTGGAATA | 2,403,948 | 83 |
| 6385. | ATGATAAATGGAGTATGAGAAAAA[C,T]CCAGGATGATAAATGGAGTATGAGA | 2,404,038 | 83 |
| 6386. | GACCCTCAGTGGTGCTGAAATAGG[C,T]CCAGGATGATAAATGGAGTATGAGA | 2,404,068 | 83 |
| 6387. | AAGGAGATACGCAGCCCACAGAAC[G,C]GTGAAGGCCGACAGGGGCATCTGAT | 2,404,123 | 83 |
| 6388. | CCCAGGTTTGAATCACGAAAGCAC[G,A]GATTAAATATCAAGATACGGGGGTT | 2,404,181 | 83 |
| 6389. | TGGGCTATGAACAGGGAAAAAATA[G,T]AACAGTCTCTATTAATTCTGTCATA | 2,404,824 | 83 |
| 6390. | AGATGGCAGGGACAGAGATGGACC[A,G]AGGGGATTTAACTAATCCAGTGTTT | 2,405,388 | 83 |
| 6391. | ACATTGTCAAAGATGGCAGGGACA[G,T]AGATGGACCAAGGGGATTTAACTAA | 2,405,398 | 83 |
| 6392. | CACCTTACATCATTGGCAAGAATT[T,C]GAGGGAGGGGAAGGAGATTAGGCCC | 2,405,727 | 83 |
| 6393. | ATGGTTGTGATAAGCATTTGGTGG[C,T]TTGATTTCAAAGCATTACAAAATTG | 2,406,720 | 83 |
| 6394. | ACCCATCGTATAGAGATAATCATG[C,T]CCAGTGATTCCTAAATCTGAAAATA | 2,407,241 | 83 |
| 6395. | TACATTCTTTCATATTTCACCAAA[C,T]AAATGAATTCCTCATCCATCCTTCC | 2,407,334 | 83 |
| 6396. | TCATACAAATATTGTTTGTCCTTT[C,T]TTTTATTTTTTATATTAAATAGAA | 2,407,400 | 83 |
| 6397. | AATAAATTAATTTATTAAATTTAT[T,A]AAATTATTTATTAAATTAAATTAAA | 2,407,585 | 83 |
| 6398. | AATTGATATATAAATAAATTAATT[T,C]ATTAAATTTATTAAATTATTTATTA | 2,407,597 | 83 |
| 6399. | ATATTTTTATTTATTAAATTTAT[T,A]AAATTATTTATTAAATTAAATTAAA | 2,407,762 | 83 |
| 6400. | TTTTTCATTCATATTATTTATATT[T,C]TTTATTTATCTTTAATTTCTGTATA | 2,407,781 | 83 |
| 6401. | GCATCCATGTCTAGTTAAGGTTAT[A,G]AGAGGGAAGATGAATGGGATTGTAA | 2,408,036 | 83 |
| 6402. | CGGCTTCTATGACTTTTTGCCTCA[C,T]CTTTAATTCTCATAAAAATTCTGAG | 2,408,854 | 83 |
| 6403. | GGAAGGACCTCTCTAATCTTTTAA[C,T]CGGCTTCTATGACTTTTTGCCTCAC | 2,408,879 | 83 |
| 6404. | TTAGCTGAACTAATATATTCATTT[T,C]ATTATTGTTATATATTTTCATACTA | 2,409,048 | 83 |
| 6405. | ACAGAGTGAGTATTCATAAATGTA[A,T]ATTTCTTGATAAGAGAACTCGTGAA | 2,409,151 | 83 |
| 6406. | AATAAAaCCCGTTCCACTGGGAT[G,A]CCACCTTAATGGTAACAGAGTGAGT | 2,409,190 | 83 |
| 6407. | TCATTCGCATCTTGGTATTTAATC[A,G]CAGTCCGATATCCGTCGTGATTCGA | 2,409,260 | 83 |
| 6408. | TGGACCAGATGCTGTTTCCAGACG[C,T]CATGTCCGAGCCGTCAGGATATGCT | 2,409,321 | 83 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 6409. | TTTGCAAGGCCTATCTTTGAAAGA[C,T]GGATTAGGGTATAAGTTAACAAATC | 2,409,765 | 83 |
| 6410. | AATACGCATTTAATATCTGCAGAT[T,C]GATTTTTTCGTTtAAAAATTTTTGA | 2,410,140 | 83 |
| 6411. | TTTATTCAAATATTTTTCAATACG[C,T]ATTTAATATCTGCAGATTGATTTTT | 2,410,158 | 83 |
| 6412. | TTTTTtAATTATGATATTCTATGA[C,T]ATATTATAATCTAATATGTCATAAT | 2,410,242 | 83 |
| 6413. | TTCGATTGATTTATGTTGTTATTA[T,C]TTTTtAACATATATTTAATATTTTt | 2,410,336 | 83 |
| 6414. | CACGTGTGGAAAAGCGAATCCACT[C,G]CGGGCCCAGGAAATTGACTGTGGGC | 2,410,910 | 83 |
| 6415. | TGATTGACATGATGTATGGTACAT[G,A]TGATATGCGGTACAGGATATCTTCT | 2,411,110 | 83 |
| 6416. | ATGAGTGCATACAGTCATACGATC[A,C]AGATAAAATGATTGACATGATGTAT | 2,411,143 | 83 |
| 6417. | TCTTCTTCACGTGGATCAATTATC[A,G]AGATGAGTGCATACAGTCATACGAT | 2,411,170 | 83 |
| 6418. | TTCATAAAAAAAAaTAGATCAAC[G,A]GTATAGAATAGAGCAAAATAATATC | 2,411,267 | 83 |
| 6419. | CAATTCAATATGTTATATTATACA[T,A]CATCTCCCCTACCAATCCAACCTTC | 2,411,441 | 83 |
| 6420. | TGCCGACAAATCATGCACACCATG[T,C]CCCTTGAGGGTGCTCTCTCCGAAAA | 2,411,580 | 83 |
| 6421. | ATCAGGCTACTCCAATGGCTACCT[C,T]CCTTTTTTTCCACACTAAAATCTGC | 2,411,627 | 83 |
| 6422. | TTCACGATTGCTGCACTCCCGCGT[C,A]GATATCTTGCAGAAGATTCCGATGG | 2,412,131 | 83 |
| 6423. | GACCACTCAAAACTATGAAAACAA[C,T]GTCATTTTCCATCCAAGTGTCTTTG | 2,414,650 | 83 |
| 6424. | TGAATATATCCTTAAAATTTTCAG[C,G]TGATGATGTACAAAAaTAAATAAA | 2,415,782 | 83 |
| 6425. | TATTGAAAACTGCATACCAATATA[A,C]GGAGTGCAGTCCTAAATTTTATAGT | 2,416,162 | 83 |
| 6426. | TGCAATACACAGAAGCTATTCATA[T,A]ATTGGTGATCAGCTTTGTGACTAAG | 2,416,662 | 83 |
| 6427. | CTAACGCAATGTGCTCGAAATAGC[T,C]TATTAATGCATTTGTGATTATTGAG | 2,416,944 | 83 |
| 6428. | CCCCCGTAGAACTACTGCAGTCAA[T,A]AAAAGAATTATAGAACGAACTAACT | 2,417,921 | 83 |
| 6429. | TTTTAAATGCACAAAATTCTCATG[A,G]TGGTGGTGAGAAAGAATAAAATATA | 2,418,347 | 83 |
| 6430. | TACTTTCTTCTTGCCTTTTTTTt[G,T]GGGGCGATAAAATGACGGTAGAGTC | 2,418,861 | 83 |
| 6431. | TTCCAGCAAATGAGATGGGCCCTT[C,T]AGCATTCGACCGACCGTTAACCATG | 2,420,049 | 83 |
| 6432. | TGTTGGCGTTTTAATTTTATTTCC[T,C]CATAAATGATTAGAAGAGTACAGTT | 2,420,252 | 83 |
| 6433. | ATATACCAAATCATCAAGTGTCCA[T,C]GGGAGGTGGAGGACATTAGAATAAA | 2,420,324 | 83 |
| 6434. | AAAATGCTAATTGGTGCTTATACA[G,T]TTCTGCATAGCTGCTTAAATTCTAA | 2,420,643 | 83 |
| 6435. | ATAATCTCAAAATATAAATTTTAT[A,T]CGTCTTATACTAAATCCTTTTTTTT | 2,420,791 | 83 |
| 6436. | GTTCACATCTTTGATACAGCCATT[G,A]AATGCTCTAGCAGCAGTAACCGTTA | 2,420,975 | 83 |
| 6437. | TATACTTTTATGTTGCTTAAGAAA[G,A]CTAGAAAATAAGATACCCATCCGAA | 2,421,287 | 83 |
| 6438. | CCGTTGCTCTCTTTTGTATTGGAC[T,C]CGAAGCAATCCAACCTTACCTTTTC | 2,421,454 | 83 |
| 6439. | GAGAGAGAGGGgAGAGATTCTGGGG[T,C]TGTGTACCTGTTTCCTAGGACGGCA | 2,422,375 | 83 |
| 6440. | CTGCCGAATGCGGAAAGAAAAGAG[G,A]AGAAACAGAAAGAATGTGTTGGGAA | 2,423,025 | 83 |
| 6441. | TCTCTTTCTCCGCTGTACCAATCT[T,G]CGCGTCAATCTAAATCTGTTCAAAAG | 2,424,121 | 83 |
| 6442. | CAGAGAAGAACTGCTGACATGCAC[A,G]AAATGAGGGTATTACCTTCCGATGT | 2,424,558 | 83 |
| 6443. | ATATACAGTATAAGGTAGCCTTCG[T,A]GGAAGTGCATGTTGACTGCTGGAAA | 2,424,629 | 83 |
| 6444. | ATGTGGAATGAGCCTACAGGAGCC[G,A]GATGCTTTTAGGAAGGAATAGACCC | 2,425,412 | 83 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 6445. | GAACGATCGGCTGTAAATACATAG[A,G]GATCGGTACTTGGAGCATTTAGACT | 2,426,903 | 83 |
| 6446. | AATCGTCATGGTTGTCCGTTGTTG[G,A]TTGATAATAATCGATTGTCGATTGA | 2,427,020 | 83 |
| 6447. | GAGGTCCGAATGAGCATCGGATGG[T,G]GACTCTGATATATCGATGATCTTCA | 2,427,085 | 83 |
| 6448. | TAACCGTTTATAATGGTTAGGTTC[C,T]GCATATTCCGATTTTATGTGATCGT | 2,427,186 | 83 |
| 6449. | TTTTTATTGTACTAAATTATCGGA[C,T]CATAATCGTGGAGTTCATAGGCTGT | 2,427,269 | 83 |
| 6450. | GTATGGGGTGAGAATTTGCCAGTG[C,T]TCATCTGTTATGTAGGTTTGAGCGT | 2,436,866 | 83 |
| 6451. | TTGAGTATGGGGTGAGAATTTGCC[A,G]GTGCTCATCTGTTATGTAGGTTTGA | 2,436,870 | 83 |
| 6452. | CAGTTGTAGTCTAGGCGATTGAGT[A,G]TGGGGTGAGAATTTGCCAGTGCTCA | 2,436,888 | 83 |
| 6453. | GGGGACCAGGTAGGCTTTTGTTGC[A,T]GAAACAAACTGACGATACAATATGA | 2,436,978 | 83 |
| 6454. | TTATACATCATTGATGTTACTAAC[G,A]AGCGATCAAAGAGAAGGATGCAGAC | 2,437,152 | 83 |
| 6455. | TCTTTTTCCAAGTTATACATCATT[G,A]ATGTTACTAACGAGCGATCAAAGAG | 2,437,164 | 83 |
| 6456. | GAGTGGGCTATGGTCTGAATTTAC[G,A]TCTGAAGTTTTTCTCTTGCTTTTT | 2,437,213 | 83 |
| 6457. | ATTGATTCTCTGTTTTGCCTTCCT[A,G]TGAAAACCTTTAACAGTGGCACCTA | 2,437,278 | 83 |
| 6458. | TTTATGATGCATGGAGGCATTAAC[G,A]GTAATTGATTCTCTGTTTTGCCTTC | 2,437,306 | 83 |
| 6459. | AAATATGTACTTGCATAAGACAAT[A,G]GTCTTTGCCATATCCCTTATTGCTT | 2,437,385 | 83 |
| 6460. | TTATGATGTCAAGGAATTTCATTC[C,A]ATGAAAATTGTAAGTAATTTTGGCA | 2,437,820 | 83 |
| 6461. | TCGTTTCTTCTTCTTCTTCTTCTt[T,C]TTTTTGGGTAAAGGGAGCATAATTT | 2,437,957 | 83 |
| 6462. | GAATCCATTTGTTACAAGGTTTAC[C,T]GGACCAAATTTTCAGGAATGTGGTA | 2,438,149 | 83 |
| 6463. | CTGGGTGATTGGAGGGCTTTCCTC[C,T]CTTGGTGATCATCCATTTGTACCCA | 2,438,300 | 83 |
| 6464. | CTFFFTGATTGGAGGGCTTTCCTC[A,G]CACTTGTTTGCAATTATTTATGGAC | 2,438,551 | 83 |
| 6465. | GCATTGCCCGGTATGGTATGCATA[C,T]GGTGGCAAGCTTAGGTTATTTGAAA | 2,438,993 | 83 |
| 6466. | CATATGTTCGGCTAGATAGTGGCC[G,A]ATGGGAAGCAAGGGATCTTTAAAGA | 2,439,296 | 83 |
| 6467. | AACATCTGCAACACGTGAAGATCT[C,T]CTAAAAGAAGCAATTCATGTAATAA | 2,439,553 | 83 |
| 6468. | TTTTGTAATTTGTAATCATAACCT[G,A]TGAAAGTCCTCGTTATTTTTGCAG | 2,439,932 | 83 |
| 6469. | CTTTGTGGCAATTCTCTGGCACTC[G,A]CCTGCGAAAATTGTGTTTAAGTGTC | 2,440,066 | 83 |
| 6470. | ATTTGCTTGCAAATTCCAAATCTG[G,T]GCAATGCAGTCTGTTCCAGATAATA | 2,440,224 | 83 |
| 6471. | TTCTTTGAGTTGCATCTACTCTAT[A,G]GTGTGTCATTTTGCTGTCAAGAACA | 2,440,273 | 83 |
| 6472. | TGCACATATTCAATGATTTTTCAT[G,A]ATCAATATCTATATAGTTTTTCTTT | 2,440,428 | 83 |
| 6473. | TTGTTTGATGCTCATCCTAAATTC[G,C]GTGCATTTAAGAAAGCTTGTATGCT | 2,440,674 | 83 |
| 6474. | AGATGTATGAAGATGTTTTGATTC[T,C]TGATCTGGATGTATATGCTTGCTTG | 2,440,721 | 83 |
| 6475. | TACAAATGGGATGTATATTCTAAA[C,T]CTTAACTGCAATCACTATGTCAACA | 2,441,097 | 83 |
| 6476. | GCAATTTGTGAAGTCTGTGGTATG[G,A]GTTGATTTGATTTTGCATTTTGGT | 2,441,011 | 83 |
| 6477. | TAGTCCCACATCAGTTGTGCGATA[G,A]GGAGATCTTGAATTTTTATATAGGA | 2,444,151 | 83 |
| 6478. | TTTTATATTTTAAATAATAAAAAT[C,T]ATTTTTAAATTTAAAaTTTTAAAA | 2,444,983 | 83 |
| 6479. | TGTTATGTGCTTCAAATAATACTT[C,T]TGAATTATCTAAAATATATTACCAC | 2,445,062 | 83 |
| 6480. | TCATAAAATACTTCTGATTAATAC[G,T]TTTCACAATTCTAATTTCTCATAAT | 2,445,178 | 83 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 6481. | TTAATCTATGCCTCTTTATCATCT[A,G]GAGTAGAGGCCTGTCTCTCTGAAAT | 2,445,603 | 83 |
| 6482. | TGAACTCAGACTCTCCTCGGTGGT[C,T]GCAGAGTTGGACCTCCAATCTGTAC | 2,445,745 | 83 |
| 6483. | TCTGCCTCTTCTGACTGGCTCCTT[G,A]ATAGAGGTGGTCCTCCTGAACTCAG | 2,445,786 | 83 |
| 6484. | GTTTTGAATCCTTGCTAGAAAAAG[C,T]ATGTGGATTCAAATCATGAATGGTG | 2,445,904 | 83 |
| 6485. | TCTTATAAAAAAAaTTCATCTTT[T,C]TGAATCTTCTTTATTACTGTCAAGA | 2,446,146 | 83 |
| 6486. | CCATTTATTCTTATAAAAAAAAaT[T,C]CATCTTTTTGAATCTTCTTTATTAC | 2,446,154 | 83 |
| 6487. | TCCAACTGAATCAATCATCTCCTT[C,T]ATCAGTCCAAAGATGTAGGTGGCGT | 2,446,336 | 83 |
| 6488. | TGATGTCCAATAAATATGCGATCG[C,T]CGCTCCATCAGCAACTCGTTGACGG | 2,446,435 | 83 |
| 6489. | GTATCCACTGTCTGTTGCACTTTA[C,T]GAAGCTTCTCAATATTCATCAACAC | 2,446,509 | 83 |
| 6490. | GGGCTGTATCCACTGTCTGTTGCA[C,T]TTTACGAAGCTTCTCAATATTCATC | 2,446,514 | 83 |
| 6491. | TCCGGTCTCAAGATCTCTCCCTCA[A,G]TATTTTTTTGCATCAATGATAGTAC | 2,446,599 | 83 |
| 6492. | CACTGACAAACATCTGATGCAAGG[C,T]TGCTTTCTTCTGTAGAAGGTTATCA | 2,446,682 | 83 |
| 6493. | GACTTCCCTCAGTACCGGCCCTCG[C,T]ATATCTGCTCTCTTCTCACTCGGCA | 2,466,730 | 83 |
| 6494. | CGCTGTCTGCGGTGCGAAGCACCT[T,C]ATATAATGGCTTGATAACCTTCACT | 2,446,832 | 83 |
| 6495. | ATTTGAGCTTTATCTTATTAATCT[G,A]TTTCTTTATTCTCTCCATCATATGA | 2,446,910 | 83 |
| 6496. | TAATGTTGATGTATTCCTAGACAT[A,G]TTTGAGCTTTATCTTATTAATCTGT | 2,446,934 | 83 |
| 6497. | TATGCTGTATTGGAACTTCGGATT[C,T]AAATAGTAAGCTGAAAATAAATTTT | 2,447,105 | 83 |
| 6498. | AGAAGCTCATTATCCATATCTATC[C,T]CGAATATGCTGTATTGGAACTTCGG | 2,447,134 | 83 |
| 6499. | TGCAATTTCAGAATCGGACACCAT[T,C]TTATATATCATATTACGGAGAGCAG | 2,447,186 | 83 |
| 6500. | GTTAAATACTCGCATCTTAATTGA[C,T]CTAACATACCTCTTGTAGACACATA | 2,447,238 | 83 |
| 6501. | ACTATCCAAAATGAATCCATCATT[T,C]AGCTACCAGAATATTAAACAAAATT | 2,447,477 | 83 |
| 6502. | ATAAGGACGAAAGTCAATCAATTA[T,C]GCTCACACCCACTAGAGGAGACCGT | 2,447,571 | 83 |
| 6503. | TTGCTGTGGATAAGGACGAAAGTC[A,G]ATCAATTATGCTCACACCCACTAGA | 2,447,580 | 83 |
| 6504. | AGTTCCAACTCCTGCTGCTTGCCT[G,A]CAAGCCATCCAATCATCAGATCCTC | 2,447,772 | 83 |
| 6505. | TGGCTTATCGGCTGGAATCCTATG[G,T]GGAATATTTGTATCTGCCCACTGTC | 2,447,887 | 83 |
| 6506. | CTTCCTGCTTGAGATGACCTACTT[T,C]GTCTCAGTATTTCTTGCTTAAATAT | 2,448,000 | 83 |
| 6507. | TCATTAATTGAGTCAGGTCTATAC[T,C]GATATCTGCCACATTACATGACTAA | 2,449,158 | 83 |
| 6508. | ATAATCAATCGTACCTTGAAATTC[T,C]TAAGCGACATTAATGATCGCTGTA | 2,449,392 | 83 |
| 6509. | GGAATTTATGGAAGAATATTTTCC[C,T]ATGGATCTTATGCAGAAAATTAGAA | 2,449,490 | 83 |
| 6510. | GATACCAATTGTAGGGAATTTATG[G,A]AAGAATATTTTCCCATGGATCTTAT | 2,449,504 | 83 |
| 6511. | CTAAAAAATATATCATTATTTTAAA[C,T]CAAATGTGAGAGTACTAAATTCATA | 2,450,644 | 83 |
| 6512. | AATCCTCTAAATCAGGGATCAACT[A,C]AAAAATATATCATTATTTAAACCAA | 2,450,666 | 83 |
| 6513. | AATGGGTCACTTTGGTGGTCACCA[T,C]CTATGAAATCTACAATCCTCTAAA | 2,450,705 | 83 |
| 6514. | TATTAATCGAAACATAACTTGTCT[A,G]ATCCTCTTAAATACTGACAGAGGA | 2,450,773 | 83 |
| 6515. | ATTAACCAATCATGCTCATGAATG[G,C]ACTCATTTATCTTGATACACCAATA | 2,450,829 | 83 |
| 6516. | ACTGTGCAAATTTTAATAAATGAG[C,T]CACTTCGGTGGTCACCATCTATTGC | 2,450,903 | 83 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 6517. | TGCACCAATAGTAAGCAATCAATC[C,A]AAGATTAACATATTTGATTCCATGA | 2,450,969 | 83 |
| 6518. | ATCTATTTGTCCAACTTAATGCAC[C,A]AATAGTAAGCAATCAATCCAAGATT | 2,450,988 | 83 |
| 6519. | TGCAATAGTTTTGCAATGCTTCTC[A,C]ATCCTTTTAAAATATCATACAGAAG | 2,451,133 | 83 |
| 6520. | CACAATCACTAGTCATAAAATATT[T,C]CACTTCAAAATTATAACACATAATA | 2,451,208 | 83 |
| 6521. | ACTATCCTAGACTATGCACAATCA[C,G]TAGTCATAAAATATTTCACTTCAAA | 2,451,224 | 83 |
| 6522. | TGCCAGGCACGGCCCATTGGGGTT[G,A]CTTTTTTAGAAAAAaGAAAAAAAa | 2,451,490 | 83 |
| 6523. | ATATTTTTATTTTtCAAATTATC[T,C]CTAAAATTAGCGTTTTATGATTGT | 2,451,725 | 83 |
| 6524. | ACGAGGAGGGTATTTACAGAAATC[C,T]TAATATTTTTATTTTtCAAATTAT | 2,451,752 | 83 |
| 6525. | GAAAATAGACGAGGAGGGTATTTA[C,T]AGAAATCTAATATTTTTATTTTt | 2,451,760 | 83 |
| 6526. | TTGCTAATTGCTAAATATTGAATA[C,T]TTGCTAAATATTGCTGAAGAGTAA | 2,451,846 | 83 |
| 6527. | GAATAGAGGTAGGTGGAGATTTGG[G,A]GCTTCCTCTTGTGCTCCTCAGGACC | 2,451,960 | 83 |
| 6528. | TTGGTTTCAGAGGAAGCAGAAACA[G,A]TAGTTTCTTCTCCATTAGAAATCAG | 2,452,095 | 83 |
| 6529. | TATACTCTTCAAAATTAAAAGACT[T,C]ATATAAGCTAAAAGATAATTCATTC | 2,452,439 | 83 |
| 6530. | TTACTAAAAAATTAGTCATAGCTA[C,T]TCTTCTAAATGTACATTTACTGGTT | 2,452,520 | 83 |
| 6531. | TATCAATATAATGAGCAGTAGCAG[T,C]AATAAAATAATAACTATCAACATAT | 2,452,643 | 83 |
| 6532. | TTTATTATCTAGAATGTGAAAAAT[C,A]AAAAATACGAAAAGCAAGAATACGT | 2,452,712 | 83 |
| 6533. | TAACAGCAGAATTATTATTAGATA[T,C]ATTGTCAAAAGTAATAGACATAATT | 2,452,811 | 83 |
| 6534. | TTGAACAAAGAGATTTAAAATATG[G,A]CATTCACATCTAATATGCAGTAAAT | 2,452,900 | 83 |
| 6535. | AATAACATCTTGAACCATATGTCA[G,A]ATTGAACAAAGAGATTTAAAATATG | 2,452,926 | 83 |
| 6536. | TTTGCTCTTGAAGTATGAATAAAA[G,A]AAACTGCATTTCTAATTTTTATAAT | 2,452,973 | 83 |
| 6537. | CTATACATATTTGCTTAAATTTTt[A,G]AAGTTTTGCTCTTGAAGTATGAATA | 2,453,002 | 83 |
| 6538. | tCAAAATTTTATCTTTGTTCCAAT[C,A]ATTTTCGATCAATGTAAAACTTAAT | 2,453,176 | 83 |
| 6539. | AAACATCATCATATCTATGTTGTA[C,T]AAATTTTTGGCTAATAAGATATGCT | 2,453,308 | 83 |
| 6540. | CATATCCTATCCCAATACTCATTC[T,C]ATTTAGATTCCATTTTATAAATAAT | 2,453,366 | 83 |
| 6541. | AAGAAGCATGTGTATGTCTCCTAT[C,G]TGCAATGAATGAGAAAATAGATGAT | 2,453,641 | 83 |
| 6542. | GTCATTGTCATCGGATGTTGTATC[G,A]TGTCCACCTTTATCTTGAAGTCTCA | 2,453,995 | 83 |
| 6543. | GTCGGCAGTGTTTGTGTCGTCATT[G,A]TCATCGGATGTTGTATCGTGTCCAC | 2,454,013 | 83 |
| 6544. | AGCAAAATTAAATATAGATGTTAG[A,G]TTTTTTTtGTAAAAaTAAAAAaCCA | 2,454,278 | 83 |
| 6545. | TAGACATGGGCAACAGGCCGGGCC[A,G]CCCAATACACAGCCTGGCCTGGCAC | 2,454,557 | 83 |
| 6546. | TTAGCAAAGTATCATCAACTTTTG[A,G]AGGTTCATCTACTTTGGTAGAATGA | 2,454,617 | 83 |
| 6547. | AATATGAGCAATATATGTGCTTAA[A,G]AAATTTTATAAGCATTATTTCAATG | 2,454,938 | 83 |
| 6548. | ATCCAAATTTCATCAAACATAGTG[A,C]TTGCTCCATTTACGTTTCCATATTT | 2,455,086 | 83 |
| 6549. | CTAAAATGATTCACCTTCTATCAT[A,C]TTCGTAGGCAGTTTATATTCTAAA | 2,455,183 | 83 |
| 6550. | ACTAATGAGGTTAAATAATTACTT[G,A]TAGTCATCATTTTTAAGTTTAACAT | 2,455,274 | 83 |
| 6551. | CTAGTTTCACAATGTAAGCCCTAA[C,T]AGCATCATCGGCATCATACCTAAATA | 2,455,383 | 83 |
| 6552. | TAGGTGCAATACTCTCTAGTTTCA[C,T]AATGTAAGCCCTAACAGCATCATGC | 2,455,398 | 83 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 6553. | GCAAGAAAAATATTAGGGATAGGG[G,A]TCTCAAACTATTAAACTTAGGTGCA | 2,455,440 | 83 |
| 6554. | CAAATTACATAAGGAGAGAGTTAA[G,A]AGCTTAATGAGCAAGAAAAATATTA | 2,455,475 | 83 |
| 6555. | ATTAGTATTGGATTTCCTACTAAC[G,A]GACAACTCAAAAGAATCTTGTAAAC | 2,455,870 | 83 |
| 6556. | TCTGCATAGTCAATTAAATAACAA[C,T]AATTAGTTCTAGTCCAAACTTTCAT | 2,455,971 | 83 |
| 6557. | TATCTTTAGTATTATCTGCATAG[T,C]CAATTAAATAACAACAATTAGTTCT | 2,455,986 | 83 |
| 6558. | ATTCTTATACCTCTTGTCAGGACA[G,A]TAGAATCTATATACTTTAGTATTAT | 2,456,020 | 83 |
| 6559. | CTGGTATTTCATTAACTGGTTATG[A,G]AGGTGCTATAATCGATTTATATATT | 2,456,234 | 83 |
| 6560. | TGGTCATTAAGAATGATGAGTTTT[C,T]CTTTTTTTtAATGATATCTTTACTG | 2,456,281 | 83 |
| 6561. | TACAAGAGACTGAATTATCCATAT[A,G]GTCAATGCCATAGTCATTCTCATCT | 2,456,343 | 83 |
| 6562. | AATTTTTCTAATGAAGCTGTAGGT[C,T]AAAACGGGTTATCAGTGTTATGATT | 2,456,409 | 83 |
| 6563. | TAGATTTACCTTTTAGGTCTGTAT[G,A]CCATATGTTTTTTCCCACTCTCAAT | 2,456,484 | 83 |
| 6564. | TCTCCCTTGACCACATGTACATCT[C,T]TAGGTTTGCAATTAGACATACCAAA | 2,456,857 | 83 |
| 6565. | CTTTTCTACATTATTCTAAGGACA[C,T]TGGTTTCTACTGAATTTGTCTCCCT | 2,456,900 | 83 |
| 6566. | ATCATATATGCTATATCTGATCTG[A,G]CACAAATCTTTGTATATATAAAACT | 2,456,988 | 83 |
| 6567. | AGCTTATTGCCTTAAGATGATCAG[T,A]CTTTCAAaAAAAAAAaGAGTTGAC | 2,457,137 | 83 |
| 6568. | AAATTCAAAATCACGATAGCTTAT[T,C]GCCTTAAGATGATCAGTCTTTCAAA | 2,457,154 | 83 |
| 6569. | GAAAAGAACATAACTGCACCATAA[T,C]CATAGTAAATCTGAAGTGGTTTCGA | 2,457,401 | 83 |
| 6570. | TATGTATTCAATTACAATGAGTCC[G,C]TTTAATCGAATCTCTGACTGTCAA | 2,457,502 | 83 |
| 6571. | ATATGATGTTCAACAAAAAATAAT[G,A]ATCCCACTAACCAAACATATCAAAA | 2,457,644 | 83 |
| 6572. | ATGCTTAAGGCTTTCATTTAAACA[T,G]CATTTACAAACAACCATATGTGCAT | 2,457,757 | 83 |
| 6573. | TAAGTAATATTTTCATGCTTAAAC[A,G]GCACATTTATGCTTAAGACTTCTAT | 2,457,841 | 83 |
| 6574. | TCTCAAGGCGAATCATGATATCAA[C,T]GATATCATTATAACATAAGTAATAT | 2,457,881 | 83 |
| 6575. | TATACAAAGCTCATCATCAGTCCA[C,T]TTTACGATTTCAAATGAAACCCTTT | 2,458,009 | 83 |
| 6576. | TTCTAGTGATGTAGTGCATGTAGT[A,G]TGAACTTTATATCCATGTGATCAAA | 2,458,060 | 83 |
| 6577. | CCACTAACATTGAATCACAGCAAT[C,T]TTCATATCATTTATTGATATTAGAC | 2,458,151 | 83 |
| 6578. | TTCATTTAGATGGCAACTTAGTCC[G,T]TATTTTTTATAACAAATCAGAATAA | 2,458,420 | 83 |
| 6579. | ATGTCAATAATATGCAATTTAATG[C,T]CATTTTGAGGTTGTATTTATCAATT | 2,458,770 | 83 |
| 6580. | CGCTATCTAACTCAAAATTGAACC[A,C]AAATATGTCAATAATATGCAATTTA | 2,458,799 | 83 |
| 6581. | tCTTTAGTTTTAAGATGACATAGT[A,T]GAAATATAATGTAAATAAATATATG | 2,458,879 | 83 |
| 6582. | AAACCGCCTGGTACGGTGCGTACC[A,C]AGCCGGACCGATGCCTTACCGGTCC | 2,460,433 | 83 |
| 6583. | GTTTGGCGAACTAAGATGTGGGGA[T,A]TGTATTGAAGAATATTTTCCCATGA | 2,460,768 | 83 |
| 6584. | AAAAATACGGTGTAGATGCCACCA[T,C]GATGTTCAAAACCCTAGATATCTCG | 2,460,855 | 83 |
| 6585. | GTCACATTTCAATGATGGTCAACC[T,C]CTACTTCATATTGCTCATATCAAGG | 2,460,983 | 83 |
| 6586. | TCATTTACTTCTGTCTTAATAGAT[G,T]ATTAAAGAACCAAAGGAGTACCTAT | 2,461,089 | 83 |
| 6587. | ATAGATACTTGTATTTGTTCATGC[T,C]GCATACATGCATGACTTCCAAATTG | 2,461,193 | 83 |
| 6588. | TTTATATTTGTTTATTTACTAATC[A,G]TTATATCTGAACTACCTTTATGGTA | 2,461,363 | 83 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 6589. | TTACTTTTTACTGTTTCATTAAT[G,T]GTTTGTACATTTTTTtCCTGCATA | 2,462,215 | 83 |
| 6590. | AATCCTTATCTCTACAAACTTGTC[A,G]TAAGAAAATAACTACTGCCATCCCC | 2,462,591 | 83 |
| 6591. | TATTTCTCCTTGATTTTATGTATA[A,G]ATCCAAATATGTGTTTATGCACCAA | 2,462,903 | 83 |
| 6592. | TTTTGCCTGTCTTTTCAGTTCTTT[G,A]TGACTATAAGAGTTCTGCTTATTTT | 2,463,360 | 83 |
| 6593. | CAGCTATCGAGAAAGAATATCCAC[G,A]GGAATCAGTCCTAATGAGCTTTAAT | 2,463,820 | 83 |
| 6594. | GAGTTTTAAAACTTTCATCTCCTT[C,A]AAATTGCAGGGAATTGTGCATGCAC | 2,463,939 | 83 |
| 6595. | GAGGCACACCGGTTAGCTGACAT[A,C]CTGATGCTTTTTCAGCCATAAGGAG | 2,464,579 | 83 |
| 6596. | TGACGGACCTGCTATGAATTTATG[T,C]GGAAAGTGGGGAATCAATCATGTCC | 2,464,650 | 83 |
| 6597. | GGGTCTCATCAAGATGGGAGGCCA[C,T]CTCTTGCTTGCAACGAGTGTGGATA | 2,464,707 | 83 |
| 6598. | TCCAAGGCCTTAGTATATCGCTAT[A,G]TTTTTCCAGATCAGAAAGAAAATAC | 2,464,792 | 83 |
| 6599. | TTGAATACATTTGGGTGGTGCAAT[A,G]TTTTTCCAGATCAGAAAGAAAATAC | 2,465,143 | 83 |
| 6600. | TGAAAGTAACTTGCCTTTTAAAAT[G,T]GGCTACCTTCTTTCAACTTTATCTA | 2,465,645 | 83 |
| 6601. | ACGGCTGAAAGTAACTTGCCTTTT[A,G]AAATGGGCTACCTTCTTTCAACTTT | 2,465,650 | 83 |
| 6602. | CTCCTTGGTTTTTATCTTTGCAAA[T,G]CTTCCAGCTCGCTAAGTAATAGCC | 2,465,845 | 83 |
| 6603. | CTTTGTATTGCTAGTCCTCCTTGG[T,C]TTTTATCTTTGCAAATGCTTCCAGC | 2,465,861 | 83 |
| 6604. | GGAATTAAGGATCATGGATTCCAT[A,T]TATCTTTGCCATTTGAAAGCAGTTT | 2,465,952 | 83 |
| 6605. | GTCAACTGCCATACTGAAAAGGTT[A,T]GGAAACATTTATATCAGTACTACTC | 2,466,165 | 83 |
| 6606. | TCTGACTTTGTTCATCTGCTGTGG[G,T]GGTAAAGTAGAAATCTGTATCTAAT | 2,466,334 | 83 |
| 6607. | GATTTTACCTTCCCAGGAGCTGGA[A,G]CCTTCCATACATGTTTTTCATCTTT | 2,466,428 | 83 |
| 6608. | TTGTCGTTTTATGTCTACAAGACA[T,A]ATGAAATTCAATATCTGTAGCATCA | 2,466,569 | 83 |
| 6609. | CCAACCTTTAAATTGTAACTTTTC[C,T]GTACAACTCTTCCAAATTCTTCTTG | 2,466,616 | 83 |
| 6610. | ATATATATATTTATATTTTCTTTTT[T,G]TtATTTtATTTTATGTTATTTTTTG | 2,467,149 | 83 |
| 6611. | CACTGATTCTCTTTTGAATTTGGA[T,C]GTTCCGACCTGTCCCAATCATCTGA | 2,467,259 | 83 |
| 6612. | ATTAAAATATATTTCCTGCCAACT[G,A]GTCTTTTGGTTTTGGTCTTCAGACT | 2,467,833 | 83 |
| 6613. | AAGGAGAGCTGTTGTATTAACTGT[T,G]CTTATTCTTGTAGAACAAAGGAGCA | 2,468,091 | 83 |
| 6614. | GTGGAATCTTTTCTTTTCTTTCCC[T,C]TTTtCTTTTGTCTCCACTAAATCTT | 2,468,620 | 83 |
| 6615. | CTTGTTTCTCTTCCCATTCCTCTT[T,C]CCATTCTTCTGCCAGCACCCCCACC | 2,468,979 | 83 |
| 6616. | CAGGACCGGGTCTTGTTTCTCTTC[C,A]CATTCCTCTTTCCATTCTTCTGCCA | 2,468,990 | 83 |
| 6617. | ATTCGGATCGATTTCTGTGATCTT[T,C]CTCGGATCGAAATATTCATGATCTT | 2,474,169 | 83 |
| 6618. | CTTTGGACTACCAGGATCATGCGA[C,T]GATCTTTTATTCGGATCGATTTCTG | 2,474,202 | 83 |
| 6619. | TAAATCCTTTTCTTTTTGGCTTTG[A,G]CTTTGGACTACCAGGATCATGCGAC | 2,474,227 | 83 |
| 6620. | GTTCACTGTCCAGAATACTGCAAA[T,C]ATTTATAGATTATCTGTTTTATCAA | 2,474,373 | 83 |
| 6621. | AAAGATAAGCAATAACACATAAAA[A,G]TCGATGTTCACTGTCCAGAATACTG | 2,474,403 | 83 |
| 6622. | ATCACATGAATATAATAATATAAT[A,C]TGAAAATAAAGATAAGCATAACAC | 2,474,435 | 83 |
| 6623. | ATCCAGGCCACAGCCAATCATAAG[T,C]ATCCTGTAACTCTGAGAAGAAAAGA | 2,474,529 | 83 |
| 6624. | TTCAATTCTCTGATCAGATACTAT[A,G]ACACTCTTATTTATTCTTCTGCTCA | 2,474,586 | 83 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 6625. | CAACAATAATTCATAAAATCTTGC[G,A]TAATTACATTTTAAATTTCTTCAAT | 2,474,630 | 83 |
| 6626. | TTATTTCAACAATAATTCATAAAAT[T,C]CTTGCGTAATTACAATTTAAATTTC | 2,474,636 | 83 |
| 6627. | TTATTtTAAAATATAATATTTTTT[C,T]TGTCATGCCTCGAACCCAACATCCG | 2,474,781 | 83 |
| 6628. | GTAGTGGAGAAGATATTGATCAGT[T,C]TTACATAGATCTGAATATTATGGAA | 2,475,317 | 83 |
| 6629. | CGGGGATCGGGGAGGGTTCTCGCA[T,C]CGGGAGGAGGAGGGAGAGGTGGGGC | 2,475,797 | 83 |
| 6630. | GGGCGATTCATAGAGTCATCTTAT[C,A]TTAAGATGACTCTATAAGTTTCCTA | 2,475,987 | 83 |
| 6631. | ATTTTAAACCTAAATATATTCTCA[G,A]GTCTAACAAATAATCCAAGCTCATG | 2,476,937 | 83 |
| 6632. | TGGACATCATCTTTGATCCAAATA[C,T]TCCAACAAAAGACAACCTCCTAATC | 2,477,052 | 83 |
| 6633. | AATCTTAGATACTTATGCAGGTTA[A,C]AGAATCCAAATAACATATTTTGGAC | 2,477,097 | 83 |
| 6634. | TTGATTTAAGGTCGCTTGCCTTCG[T,A]TGCATGCATGGTAACTATCAGACCT | 2,478,290 | 83 |
| 6635. | ACGAGGAAGAAGGGCTTGCACCAG[A,C]GGGGACATCTAAAACTCCAAGTTCA | 2,478,393 | 83 |
| 6636. | GTTTATGCTCTACTATAAATATAT[G,A]TGGACCCGCCGTGAGAATGCCCGTC | 2,478,466 | 83 |
| 6637. | CTTCAATCTGATGAGAAAGTATTT[C,A]GAAATTCCCAGCTTAACTACAACAT | 2,478,789 | 83 |
| 6638. | ACAAGAGTTAACTAAAACAGAATC[T,G]TCAATCTGATGAGAAAGTATTTCGA | 2,478,812 | 83 |
| 6639. | AGGACTGCTTATCTAATAGGCCTA[C,T]TGAAAAATAATTTACAAGAGTTAAC | 2,478,850 | 83 |
| 6640. | ATTTAGATTCATCTCCTGCAACAT[G,A]GAGTAGCAGAAAACCTTTGGTGTTC | 2,478,917 | 83 |
| 6641. | TTTTTTTTTtAGAATTAATTTAG[A,G]TTCATCTCCTGCAACATGGAGTAGC | 2,478,935 | 83 |
| 6642. | GTGTATAGATTCTAATTAAAAGTG[T,C]CATCCATTATTTACACATTTAATTA | 2,479,010 | 83 |
| 6643. | GTGGAAATGGGGTGCCGTAAACTT[A,G]CATAATGCTGATGTGTATAGATTCT | 2,479,047 | 83 |
| 6644. | GGGCGGCGTGAAGGGTGGAAATGG[G,A]GTGCCGTAAACTTACATAATGCTGA | 2,479,061 | 83 |
| 6645. | TTAGAAGATCTAGGTGAACCAATT[A,T]GTTCTTTTAGTAGATACAGTGAATG | 2,479,191 | 83 |
| 6646. | CCTACCCTAATTTCTGTGCCCGTA[G,T]GTCTTTATATGTTTAAATTGCCTTG | 2,479,265 | 83 |
| 6647. | ACTAGTTATGGGCTATCTGAATGA[G,C]AGCAAGTTAACCTGTCTGCCCTCCT | 2,479,536 | 83 |
| 6648. | ATGGAACGGCATCAAACCACATAC[G,C]TTGGTATGAGATAGAAGGATTGGGC | 2,479,951 | 83 |
| 6649. | CTGTGGACCACACGGCTAAAAGAAG[A,C]GTAGTCTTCTGCTTCACCCTATGTC | 2,480,026 | 83 |
| 6650. | CCGATACATGCTGGATAGTAATTT[A,G]AAGTGGGTCTGTCAGCCCATCAAAT | 2,480,677 | 83 |
| 6651. | GATTTGAAAGATTGACTCATATGG[T,C]GGCATTTAAATGCTAAGACTAGAGC | 2,480,868 | 83 |
| 6652. | GATTATTGATATGATGAGCTCTTA[C,T]TTGATAGTTAATATGTGGATATATA | 2,483,324 | 83 |
| 6653. | GTCGTTTCTTGTGATTATTGATAT[G,C]ATGAGCTCTTACTTGATAGTTAATA | 2,483,336 | 83 |
| 6654. | TAAGTATACAATTAGCTGCTATTA[A,C]ATGGCACGGGATTGTTTATAAAATT | 2,483,558 | 83 |
| 6655. | GCTTGCCACATCAAGTCATGGGTT[A,G]GATCATCCAAGCAAGAGGAAAAAAC | 2,484,236 | 83 |
| 6656. | ATGTGGCCTTCATCAATCCGTACA[C,T]GTGATTATTTAAGGAACAATGGATA | 2,484,323 | 83 |
| 6657. | ACATGTGGCCTTCATCAATCCGTA[C,A]ACGTGATTATTTAAGGAACAATGGA | 2,484,325 | 83 |
| 6658. | AACCATCCAAATTTTTTAGATTAC[G,A]AGGAGGCCCACCACCTAACATGTGG | 2,484,367 | 83 |
| 6659. | ATATGGAACATTGAAAATCCTTTC[T,C]AACCATCCAAATTTTTTAGATTACG | 2,484,392 | 83 |
| 6660. | ATATATCTTCATATAGTGTCGGTC[T,C]TTATTTTTTCTTTCTTTTCTTATTG | 2,484,685 | 83 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 6661. | TTtGATAAAAATAGGAAATAAAAG[T,C]TACTGAAAATCCGGAAGCATCTTCA | 2,484,863 | 83 |
| 6662. | TTTtATTTTTTTTtGATAAAAATA[G,A]GAAATAAAAGTTACTGAAAATCCGG | 2,484,874 | 83 |
| 6663. | GATTTTtATTTTTTTtGATAAAAA[A,T]TAGGAAATAAAAGTTACTGAAAATC | 2,484,877 | 83 |
| 6664. | GGTAAAAAGATACCTTAAAAAGGG[C,A]GTGATCCATTAATTTAAAAACCTAG | 2,485,105 | 83 |
| 6665. | TGATCTCCACGCGGTTTGATGATC[A,T]CCAGGCGAGGGCTCGACAAAAGTG | 2,485,407 | 83 |
| 6666. | TTGAACAAGCACGCCCTTTTCCCA[T,G]ATTAAATCCACTCGCCCTGGACTTT | 2,485,813 | 83 |
| 6667. | ATACGGAGGATTACTTTGAAAATT[T,C]TTAAAGGAAAAGGGGTATGTGTGA | 2,485,886 | 83 |
| 6668. | AGACGTTCATGAACTGGTGGCCGT[A,T]GGAAATGTTGTCCAAACAACTGATA | 2,486,037 | 83 |
| 6669. | TTGGTATGCGTCAAATTGAAAGGC[G,A]CTGCTTCTCAAAGATTGAAACAATG | 2,486,212 | 83 |
| 6670. | CGAGCCACAAGAAAACTTTCCATG[A,G]TGGTCTTGCATACAAAATTTTATTT | 2,486,301 | 83 |
| 6671. | ATACAGTTGTCAACCTAACATGCA[T,C]CGGCACTTAAGGAATGATAGCGTGG | 2,486,357 | 83 |
| 6672. | ATTCTTGTGTACTTCACCTCTTTT[G,T]GTATATTTCTTTTCTTTTTtAAAT | 2,486,783 | 83 |
| 6673. | TAATCTTAATAACCATATGTACAA[T,C]TGTACACTATGCTACAATAGTTCCC | 2,488,451 | 83 |
| 6674. | TTAAGTTAGTAGTATCATTTTGT[A,C]AACATTAAAGAAACAAAACTTTTACT | 2,488,512 | 83 |
| 6675. | CGTCGTCGCCGCCGTCCGGCATGA[A,G]ACGAAGGACGCCGCCGTAATCATCA | 2,489,080 | 83 |
| 6676. | CACGACTGGTGGTAATAGTAGCAG[T,A]CCTAGTGGTGGCAAACAGAAAACAA | 2,489,754 | 83 |
| 6677. | AAATCCCGTGTTGCTTGAATGGCC[G,C]AACGTAGCAACTACTTGGGTTGGAG | 2,490,707 | 83 |
| 6678. | ATTGACCAATCAAAAAGTTAAACA[G,A]CCACTGTATCTTTTTCACGAGATTT | 2,491,016 | 83 |
| 6679. | GTTGATTGACCAATCAAAAGGCTA[G,C]ACAAGTACAGAGCAGTGAATTGACC | 2,491,059 | 83 |
| 6680. | GCTGCTTGTTGGTACTCGACAACA[A,T]ACAATACATCAGTTTTCATCAAAaA | 2,491,133, | 83 |
| 6681. | TGGTAAATGTTTCTTGATGCAATT[C,T]GTCAGCTAATTGACCCATCAAAAGG | 2,491,182 | 83 |
| 6682. | AAGTAACAGCTAACAATGGTGTTT[A,G]TTATACATGAAGAACCTTCACAGCT | 2,491,298 | 83 |
| 6683. | CCACATGCTCAAGAAACTTAGAGA[C,A]ACATATAAAGTAACAGCTAACAATG | 2,491,330 | 83 |
| 6684. | CTCGTCTCCGACTCCGATTGGGAG[C,T]CGGCGAGAGGAGGAAGAAGACTCCC | 2,706,922 | 83 |
| 6685. | TTTGAAGCATGATGGCACCTGAAG[T,A]CTAAGTCATTTGCGGCATTTGAAGA | 2,800,319 | 83 |
| 6686. | GAGGGCTATCAAGGCAACATGGTA[A,T]GGTAACATCATGCCAGTAGCTAGTT | 2,800,654 | 83 |
| 6687. | ACCAAAGAGGTAGTTGATGATTCA[T,A]AAGCTTGTATTTATTAATGACAACA | 2,801,242 | 83 |
| 6688. | ATCTGTTGCACTTAAAAACAAATA[A,G]GAGGAAGGTCCAACCAAAGTAACAA | 2,801,363 | 83 |
| 6689. | CGCGCCCTACTATAAAACGGAGAA[A,G]GCAACAGTGCTGGTAAAGGTTCTTT | 2,801,988 | 83 |
| 6690. | CCATGCCGCGCCCTACTATAAAAC[G,A]GAGAAAGCAACAGTGCTGGTAAAGG | 2,801,994 | 83 |
| 6691. | CACCGATAGGACGCATGACACCGA[T,C]GGGACGCCTGACACCGACGGGACGC | 2,802,698 | 83 |
| 6692. | GTTCGGCCCAACGGCCCCCCGCCA[C,T]GTGGCGGAAGAGTCGTGGCGGTTCG | 2,802,802 | 83 |
| 6693. | CGACCAGCGAGGATCTCCCAGATC[G,A]TGACGCGTGGCAATATCTGGGCCTT | 2,802,919 | 83 |
| 6694. | GGTCGAGATGAAGGCACGACCAGC[G,T]AGGATCTCCCAGATCGTGACGCGTG | 2,802,935 | 83 |
| 6695. | GAAAGAGGAGGACTACGAGGAAGC[G,A]AGGAAGAGAACAAAGGACAATGGGG | 2,803,088 | 83 |
| 6696. | AAAGAGGAAGAAAGAGGAGGACTA[C,T]GAGGAAGCGAGGAAGAGAACAAAGG | 2,803,097 | 83 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 6697. | AGGAGATATTCTAGCCATTACGCC[G,A]GAACAGAGGTCAAAGAATAAAAGAG | 2,803,141 | 83 |
| 6698. | GACCGACTTCCTCGAGGAGATATT[C,T]TAGCCATTACGCCGGAACAGAGGTC | 2,803,155 | 83 |
| 6699. | CGTTCGGCCCCGAAAGTGAAGAGA[T,C]CTCCACCTCCAGGGTCGATCGAGAA | 2,803,223 | 83 |
| 6700. | GGATGCAGTACTGCTCCCGGAGCC[G,A]ATCAACGTTCGGCCCCGAAAGTGAA | 2,803,253 | 83 |
| 6701. | GCTCTGGGATGCAGTACTGCTCCC[G,A]GAGCCGATCAACGTTCGGCCCCGAA | 2,803,259 | 83 |
| 6702. | AGGGGCGAACAGCTGAAATTGCTC[T,C]GGGATGCAGTACTGCTCCCGGAGCC | 2,803,279 | 83 |
| 6703. | CCTCAGACGGGCTGTTAACCCGAC[C,A]ATTGGCTCCAGGGGCGAACAGCTGA | 2,803,313 | 83 |
| 6704. | TAGAGATGTATTAAAAAGTGAGTA[G,T]TACCACATCATCACAAAATAGATCA | 2,812,889 | 83 |
| 6705. | AGGCCTTTGAGAGATTGTGGCTAC[T,G]CATATCAAATCAAAGAGATTTTCTA | 2,813,811 | 83 |
| 6706. | ACAGTCTAAACTGATGGGCCATG[C,T]GCTGATAAGTCAATCTTCTCATTCT | 2,814,800 | 83 |
| 6707. | ATAAATATATATGCTTTTTTTAAG[C,T]TTTATTCCAGTATCTATGTCATATT | 2,816,787 | 83 |
| 6708. | AATAAATATATATGCTTTTTTTAA[A,A]CTTTATTCCAGTATCTATGTCATAT | 2,816,788 | 83 |
| 6709. | GTCTCACTAAGCAATATCATCTGG[G,A]GTTTTAATGTTCAGCTGAAGCTGAT | 2,816,969 | 83 |
| 6710. | ATCCTTCTATTTCTCTTCAAAGCA[G,A]ATCTGATACAGGATAGAAACTGTTT | 2,817,183 | 83 |
| 6711. | ATAGCAAACAGCAAATGGGGATCC[G,A]AGGGCTGTCGAAACATATAACATGG | 2,818,649 | 83 |
| 6712. | CAATCAGAATTGCTTTATTGTTGG[G,A]GAAAAACATATATTGCCAATTGCAA | 2,819,792 | 83 |
| 6713. | CATATAAAAAaCTTACTTTTTAA[T,A]ATGAAAGAAGGGGAAAAAGGTCTGT | 2,820,563 | 83 |
| 6714. | TGAATGGACTATTTTACCTTTTAT[C,A]TTTTTTtATTTGATGGATTTAAAAT | 2,820,764 | 83 |
| 6715. | TAAAAATTCCAGAATATCAATATC[G,A]CACAACTAATAGAAAGATCAAGTGA | 2,820,811 | 83 |
| 6716. | GCGGCATTTAAAAAACAAGAACCA[C,T]AACTGCAAACTGTTTAAAAGCCGCT | 2,822,617 | 83 |
| 6717. | CTGATACCAGTGACTGAATCTGAA[C,T]CGGATTTGATAAGATCAAATTCGAA | 2,829,117 | 83 |
| 6718. | AAGAACTGATACCAGTGACTGAAT[C,T]TGAACCGGATTTGATAAGATCAAAT | 2,829,122 | 83 |
| 6719. | TGGGAGTCTAATTGTTGAAAAAAT[G,A]CATCAGTTTAGTAATATAACCTAGC | 2,842,761 | 83 |
| 6720. | GAACACCGGTGCTATTGTGGCTAC[T,A]TGTCGAACGAAGAGTACAGGCATTA | 2,843,219 | 83 |
| 6721. | TGAAGGAATCTTATCACGAGACCG[C,T]AATTCAATGGATGCAGATATCCAGC | 2,843,441 | 83 |
| 6722. | AAAATGGTTGTGTGTTTTATACCA[G,A]TGTAAATCTCTACACCGTTGTTACT | 2,843,528 | 83 |
| 6723. | CTTCAAACTTTGGATGGCCATCAA[G,C]CCTGAGATTTACTGCTTGTCTGATG | 2,843,580 | 83 |
| 6724. | TATTCAGGAGGAGAGAGGAGGCTC[G,A]GAGGCTGCTCAAGGAATCGCTTCAA | 2,843,624 | 83 |
| 6725. | TAAAATCTCCTTAATGCAAGTAAT[C,T]GGAGAACAACCAAACAAAGGCGAAC | 2,845,049 | 83 |
| 6726. | ATTTGATCTTTGAGACCGCTGTAC[A,G]TATCCCCTGATTCTTCTGATTTCTA | 2,845,702 | 83 |
| 6727. | TTCCCTCTGCTGTCTGTAATTATT[T,C]GATCTTTGAGACCGCTGTACATATC | 2,845,723 | 83 |
| 6728. | TATTTTTACCCAATTTTTCCCTCT[G,A]CTGTCTGTAATTATTTGATCTTTGA | 2,845,739 | 83 |
| 6729. | TCTTCCTTTGTTAGTAAATTGGGC[C,G]TCAAAAAATCCAATTTTAGTTCACT | 2,847,419 | 83 |
| 6730. | TGAGAGAATAAAATAAGATCAATA[C,T]AAGAGGAACTTACCACTCAATCGTT | 2,847,419 | 83 |
| 6731. | GGAACTTACCACTCAATCGTTGTA[C,T]AAGAGTCTCTCAAGAAAAAATCCCA | 2,847,419 | 83 |
| 6732. | GGCTCAATGTGGACCAAATTTTAA[A,G]GTGTATTTCCTAACAAGCATGCATA | 2,847,419 | 83 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 6733. | ATTCCTCTTCCTTTGTTAGTAAAT[T,A]GGGCCTCAAAAAATCCAATTTTAGT | 2,847,424 | 83 |
| 6734. | ATATTTGTTGGCTACATTATAGTA[T,G]TGTGATGTGTTTTGGCGGAAATGGG | 2,847,504 | 83 |
| 6735. | ATACAGAAATCAAGGCAGAACCCT[C,A]TTTTTATTTTCTGTTCTTTGAAACT | 2,848,281 | 83 |
| 6736. | AAATTTCTTCAGTCTTTGAGACTT[A,G]TATCTCTATGTTCTTACAATTTTCA | 2,849,480 | 83 |
| 6737. | AGACGGTGCAATCACGGCTTGTGG[C,T]GCTACGGACGTGAAACAGGGGCGAT | 2,850,223 | 83 |
| 6738. | CTCCACCTTTTGCTTTTTTTCCCG[G,A]AGACCCCTTTTTCTCTCTCCTTTTA | 2,854,559 | 83 |
| 6739. | GGTAAGTTTTTAGTTTCATATTTC[C,T]TTGTTTTATCTCTCAAAATCTATAC | 2,855,805 | 83 |
| 6740. | AGATCAGAACACAATTATAATTAT[G,A]TATTGGTAAGTTTTTAGTTTCATAT | 2,855,834 | 83 |
| 6741. | CACTCCAAGGTAAATGTTGGGCAT[C,T]TAGGAGATGTTGTAGGTAAGTTTGG | 2,856,782 | 83 |
| 6742. | CTAGATGGATATTAAGTTCTATGA[A,G]ACATCAGATGACTAGCTTTACTATA | 2,856,918 | 83 |
| 6743. | GCTCTTGGCCAATTAGAGAGTGCT[C,T]CATTTCTCATGCATGGAGTAAGTAG | 2,857,691 | 83 |
| 6744. | CGTGGCCCACTATTTCGACTCATC[T,C]CTTCCGACTCCCAAGACTTCATCA | 2,857,782 | 83 |
| 6745. | ATGAAAACTCTTAAATCTCTACTA[C,T]GTGGCCCACTATTTCGACTCATCTC | 2,857,806 | 83 |
| 6746. | CGATGACCCCTCTTTCTCCCTCCT[C,T]TTCCTCCTCACCCCTTCTCCTCGT | 2,858,318 | 83 |
| 6747. | TCCAAGCCCATCCATCAGCCTTTT[C,G]TCTTCACAGTGACTCCTTTTATGTC | 2,858,506 | 83 |
| 6748. | AACATCCCTCCTTCATCCTCCTCT[C,T]CTTCCTCATTATCCCCTTCTCCTCT | 2,858,704 | 83 |
| 6749. | GATTTGAACTCTAAATCTTTGGAG[G,A]CCTAACCAAAATCTTAATCAATAAG | 2,859,030 | 83 |
| 6750. | TATTAGGTTCAAGTCGGATCATTG[G,A]AATTCAGTAAATCTAGACCATACCT | 2,859,248 | 83 |
| 6751. | GACTTTGTGTCAAGAGCTAAAACA[G,A]ACATTACCTAATTATGTATTTTTA | 2,859,529 | 83 |
| 6752. | ATTAGATTGGATTGTCACGAGTGA[C,T]TTTGGCTCGATCTGGTTCATTGATT | 2,859,877 | 83 |
| 6753. | TTCTCTAAGATAGGGTCGACAGTG[A,G]TAAATGCCGAAGATTTGACCAGGGC | 2,860,349 | 83 |
| 6754. | CAGCCCTATCATTGTCATCTTCTC[C,T]TTGAGCAGCATCGGCAGCAACATCA | 2,860,494 | 83 |
| 6755. | ATGACGTCCGTAGATGTAATAGGT[G,A]TATACTTGCATCAGCATCACGAACT | 2,862,935 | 83 |
| 6756. | ACTGTGATATAAAAATATTGCTAT[C,T]GACAATGGATCGATCGTACCGTACC | 2,863,295 | 83 |
| 6757. | CATCCAAACCCGTTACTTCCAAAA[T,C]TTGACCTTCAATTTAGTATCCCATG | 2,863,493 | 83 |
| 6758. | TCAACTTCAGGACTGCTCTAGCTT[C,A]TATTGAAGGTATACAAGTAGCTTGC | 2,865,195 | 83 |
| 6759. | TGGTGGCTCCACTGGCTCTTGTAT[T,G]TTTCCCCCCTCAATTTAACGAAAA | 2,865,263 | 83 |
| 6760. | CTGCGTCATTTATTTTGATCTTCA[C,A]TTTTTGCCCCAGAAATTCACGAGCA | 2,865,673 | 83 |
| 6761. | GCATGAGCCAAATCAGCACAGACC[A,G]ATATACCGGACCAATAAACGTCATT | 2,866,109 | 83 |
| 6762. | TATGAGCACTTCCAATGGATCTAA[C,A]TTGTAGTGCCCTAAGTAATTATGAC | 2,867,753 | 83 |
| 6763. | TCCACATGGTTCCTGGAGAGTTCT[T,C]GGGCTTCCATATGAGCACTTCCAAT | 2,867,787 | 83 |
| 6764. | CGTCAATTGCCTTTTGACTGCAGT[T,C]GGCTTGGCATCGGAATGTTTGTGCA | 2,867,867 | 83 |
| 6765. | CCGCCAGATGCAGGCTGGGCCTTT[T,C]CACTTAGCTTTAACAAATTGGACTT | 2,869,059 | 83 |
| 6766. | GTGGGACCAAGGAGGAGTGGATGG[T,G]GGTGTGCAGTGAATGGACGAGGGGG | 2,870,470 | 83 |
| 6767. | CATAAGATCAGATTATTGACAAAA[G,A]TTAGCCATATAAGAGATGGATTATT | 2,871,201 | 83 |
| 6768. | TCCAGAATTGTACAAAGACCGAGG[A,T]ATTGTGTTTTACTCATGCCTGATAC | 2,871,834 | 83 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 6769. | AATTATCAGCCTTTTTTGAATTGT[A,T]ATTGTGTTTTACTCATGCCTGATAC | 2,871,941 | 83 |
| 6770. | GACAATCCATGAAGTTAATTAAAA[A,G]AAaTATGCTTTTGCTATTTATAGAA | 2,872,443 | 83 |
| 6771. | AAGTGGTTATTTAGTCAAATCCAT[T,G]CAATTATAGAATTTTATATTTATTT | 2,873,238 | 83 |
| 6772. | TACTCATAGTTAAAATCATTAAGC[G,T]ATCTCTTGTTACAAGATCCAACAAA | 2,874,531 | 83 |
| 6773. | ATCTGTTGGTTTCCTCAACTTGCA[C,T]ATTCAGGGGAGATGACTGGAAGAAC | 2,875,226 | 83 |
| 6774. | CTTTATCTCTCCCTCTCTTTTTGC[T,G]GGCGCGCGCCTGAAATTAGTATCCT | 2,876,078 | 83 |
| 6775. | ACTCGTTGGATTGAAAATTCTAAT[C,A]ATGGACTTGATCTAACCTAATCCGA | 2,876,988 | 83 |
| 6776. | GACTCAATCCAATCCAAATGACTC[G,A]TTGGATTGAAAATTCTAACCATGGA | 2,877,008 | 83 |
| 6777. | CTGGATTCAAATCTTTTGGATTGA[C,A]GCTGGATTATATTTGGACTCAATCC | 2,877,048 | 83 |
| 6778. | ATATATTTAATATAAAAATATATT[C,T]AGAATTATTTTTGTATCCTAATTTA | 2,877,205 | 83 |
| 6779. | TAAAAAATCCATGGGACTGGATTA[A,G]GTTCTAAAATTGAGTATGTTCTATT | 2,877,424 | 83 |
| 6780. | GCCATATAGAGTCTAGACATAAGA[G,A]CTTCAAATTTAGAGTTATTTTAGAA | 2,878,050 | 83 |
| 6781. | ATTTTTTAAAAATACAAAAGTTAT[T,C]TAAATAATTTACAGATATCTAAATA | 2,878,317 | 83 |
| 6782. | TTTAAATTTAAACTCAAATGGATA[A,G]TTTTTCCTTATTTATCCTACATATT | 2,878,456 | 83 |
| 6783. | TAGCAATTCGAGGTAAATTCCCAT[C,G]GCGGCGCCAATATGAAGCATAAGAA | 2,880,961 | 83 |
| 6784. | TTTCCGTCTTATCCTGCAGCTAGT[A,C]CAGGAAATTTATGCCAAAATGGTGT | 2,881,058 | 83 |
| 6785. | TGCATGGTAAGTATGTATTTCCGT[C,T]TTATCCTGCAGCTAGTACAGGAAAT | 2,881,075 | 83 |
| 6786. | TGGAAACCATGCATGGTAAGTATG[T,A]ATTTCCGTCTTATCCTGCAGCTAGT | 2,881,084 | 83 |
| 6787. | CTATCAGTAAGAAGATATAGAAGC[A,C]GAAGAAATCTCTCGCATATCAAATA | 2,881,283 | 83 |
| 6788. | TACGGATTCTGTTATATAAATGAA[C,T]AGGTATTGCAGTTTTATGCCTCTTC | 2,881,343 | 83 |
| 6789. | GATACGGATTCTGTTATATAAATG[A,T]ACAGGTATTGCAGTTTTATGCCTCT | 2,881,345 | 83 |
| 6790. | AAGCAAAACAACCTTAGATTTCAG[C,T]TCTGCAGATATTCCAAGAGCCTCAG | 2,881,561 | 83 |
| 6791. | TTATCTATCTTTCTTGATATTAAG[T,C]ATGGATGAAAGTCCAACTCCGTCAA | 2,881,962 | 83 |
| 6792. | TGAACCCATAAATGTTGATTACCA[T,A]CTAATAAGAGGGGAAACAAAAGAAA | 2,882,414 | 83 |
| 6793. | ATCTGAACTGCAACAAGTTACTAT[A,G]TTATACATTAAAGAAAGAATGAAAT | 2,882,945 | 83 |
| 6794. | CACCATATTTTGCCAGTAACCCCT[A,G]TTCAGAACTGCAAATTAACATAAAG | 2,883,161 | 83 |
| 6795. | TTATTTTGATAGTTTTAACGGCTG[T,G]TTCTTTGGATTTTCATACCTCATCC | 2,883,410 | 83 |
| 6796. | AATTATGTGCAAGTAAACAGAATT[T,C]ATACCATGTGTTGCAAAAAACACAT | 2,883,716 | 83 |
| 6797. | ATTGGAAGCAATTACGAATACATA[T,A]AATGTGCAACTAAACAAAGTTCATA | 2,883,774 | 83 |
| 6798. | AAATGAAATCAGTGTAACTCCTCA[A,C]AAAATTCTGCAGAACACAGAGATTT | 2,883,825 | 83 |
| 6799. | AGAACAGAGCCTTTTTACTAACAA[G,C]TCACAAAGATGAGAAAAGTCCCAAG | 2,884,081 | 83 |
| 6800. | GAATGATGGGACCTACAGAACAGA[G,T]TCCTTTTTACTAACAAGTCACAAAGA | 2,884,097 | 83 |
| 6801. | AGTAGCAATTGGTTGGATGTGGAT[C,T]GGGTTTGATTTTATCCACACTAGAA | 2,887,764 | 83 |
| 6802. | TTtCGTCTTTCTCTTTTCGTGGTG[C,T]GCAGGGAAACTGAGCTGGTGGGCTA | 2,887,828 | 83 |
| 6803. | CGAGTGAAGCCATATGGACCCCGC[T,G]AACGCCATCCACCTCGCCAGCGAAT | 2,887,908 | 83 |
| 6804. | AGGAAAAATACCATGAAAGTAGTT[T,G]GCAAGCTAACTAATACTATGAAAAT | 2,888,437 | 83 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 6805. | CAATATTTCTCTCACAATCCCAAC[C,T]AAATACAAAGAATTTGAACTAAAGA | 2,888,488 | 83 |
| 6806. | TTCCCAACTCTATTCAATATTTCT[C,T]TCACAATCCCAACCAAATACAAAGA | 2,888,502 | 83 |
| 6807. | AAATTTTTTGAACCAAATGATAGA[T,C]GGAGATTATCTATTTTCCCAACTCT | 2,888,541 | 83 |
| 6808. | ACTTTCTTTGTATTCCCATAATTT[G,A]TCAGGATTTTACAAAAGGTTAATAA | 2,888,629 | 83 |
| 6809. | CCATCCCTCTATGTTCTATCCAAC[T,C]TTCTTTGTATTCCCATAATTTGGAA | 2,888,651 | 83 |
| 6810. | AAATAAATAAAaaGGTAAAAAaGT[G,A]TCAGGATTTTACAAAAGGTTAATAA | 2,888,724 | 83 |
| 6811. | TATAAATAAAATAAATAAAaGGT[A,C]AAAAaGTGTCAGGATTTTACAAAAG | 2,888,732 | 83 |
| 6812. | TGAAATTTAAAAATATAAGATAAG[C,T]AATATAGATAAAATAAATATATATA | 2,889,853 | 83 |
| 6813. | ATAATTAATTTATAATTTGATTTA[G,A]GTAGTTAACTAATTTTATATAAATA | 2,889,001 | 83 |
| 6814. | TATAAATAATTAATTAAAAATAAT[G,A]AATATTAATAAAAATAGAGTATAAT | 2,889,201 | 83 |
| 6815. | TATAAATACTAAAGAAGTAGAGCA[A,C]TATATAAGGTACAAATTTAAAATTT | 2,889,372 | 83 |
| 6816. | TTTCTCCTCTATTTAATACAAGAG[A,G]AATGAAAGAAAGAATGAATGATATT | 2,889,488 | 83 |
| 6817. | TCCATTCATCCTCTCATATATTTG[G,A]TAAAAtaTAAAAAAaTAGATGAAAA | 2,889,542 | 83 |
| 6818. | ATTTATTTATACTAAAGAAGTAAA[T,C]AATATAGATACTTATAATCTTTGTA | 2,890,200 | 83 |
| 6819. | AAATAAAAAaTGGATGATATTTA[G,C]ATAATATTTTTACTAAAATATCTTT | 2,890,288 | 83 |
| 6820. | AAAATAAATAAAAAAaTGGATGAT[A,A]TTTAGATAATATTTTTACTAAAATA | 2,890,293 | 83 |
| 6821. | TAAAATATGAAAAATGGATAAAA[A,G]TTATTTCTTCTTCTATTTGATATAA | 2,890,341 | 83 |
| 6822. | TCAACTAACATGCACCACTATTAG[C,T]AGGTAAATATCGTGCACATGAATCC | 2,890,495 | 83 |
| 6823. | GAAGCCTAAGCAACCTCATACCTT[A,G]GCTCAACTAACATGCACCACTATTA | 2,890,522 | 83 |
| 6824. | CAATTGTTGCTCCTTTAATCATAT[T,A]TATTGAGGGAAGCCTAAGCAACCTC | 2,890,555 | 83 |
| 6825. | ATCACCATCTCTATGATGATCCTA[C,T]GATTGAGAGCAATTTATGAGTTAAC | 2,890,870 | 83 |
| 6826. | ATCTTTTGGATCGATCACCATCTC[T,C]ATGATGATCCTACGATTGAGAGCAA | 2,890,883 | 83 |
| 6827. | CGAAGAGAGTGATCGTACATCAAT[C,A]TTTTGGATCGATCACCATCTCTATG | 2,890,905 | 83 |
| 6828. | TGTCTGCACACCATAAAATCAAGA[C,T]TCATCTATCCGAAGAGAGTGATCCT | 2,890,939 | 83 |
| 6829. | TCGCTTCGGTGTCTGCACACCATA[A,G]AATCAAGACTCATCTATCCGAAGAG | 2,890,948 | 83 |
| 6830. | TAAACACACAACCGCAGCTATGAA[T,C]ATGCCACTAATGAAAAGTAGATAT | 2,891,060 | 83 |
| 6831. | TCGAATTATGGTGTAGTCAAACTA[T,C]AGCACCCTCAAGATGAATTGTCGAT | 2,891,129 | 83 |
| 6832. | ACTACAGCCAACATACACCTTAAG[A,G]CTCCGTATGGCTAGAAAATCGAATT | 2,891,172 | 83 |
| 6833. | TTAATTTCTGCAATGAATATACTA[C,T]AGCCAACATACACCTTAAGACTCCG | 2,891,192 | 83 |
| 6834. | TCGAGATCTAGAGATTTCATCTTT[A,G]TGCAATTTAATTTCTGCAATGAATA | 2,891,223 | 83 |
| 6835. | CTTTTCTATCTTTCACACTGTCAT[G,A]GCTATAGATTTGTGGACTCAATTTC | 2,891,302 | 83 |
| 6836. | CCAGTAGAACTGAAAGATGAATCT[T,C]ATGTGCTAGCATAACTCCCTTAAAC | 2,891,466 | 83 |
| 6837. | AGTAACATCTAGCAGTATATAGTG[G,A]CAATCCAGTAGAACTGAAAGATGAA | 2,891,495 | 83 |
| 6838. | CATGTAGGAGAAAATGGGTTTAAC[T,C]ATGTGCTAGCATAACTCCCTTAAAC | 2,891,787 | 83 |
| 6839. | CTATCTAATAGGAAACCCAAATCA[T,A]GTAGGAGAAAATGGGTTTAACTATG | 2,891,809 | 83 |
| 6840. | CATGGCCGAACAACATTGGGTGGC[G,A]CCAACATTTGACGCCCCATAAAGCC | 2,891,937 | 83 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 6841. | AAATCCATATGGGTGTGAGCCCTC[G,A]TCATGGCCGAACAACATTGGGTGGC | 2,891,963 | 83 |
| 6842. | TAGTAGATAAGGCTTATCCCTCTC[C,T]CTCTCTCTTATCTGAATTTGGATGA | 2,892,025 | 83 |
| 6843. | AATCTCTTATCCTCATCCACTAGT[A,G]GATAAGGCTTATCCCTCTCCCTCTC | 2,892,045 | 83 |
| 6844. | TTCAAATCTAAATTTAAATTCAAA[G,A]GAGATCAAATCTCTTATCCTCATCC | 2,892,077 | 83 |
| 6845. | ATCAATGAAAAATTTAGATTGGCA[C,T]GGAGATAGGATAAGGTTGTTGTCGC | 2,892,181 | 83 |
| 6846. | TGTTTTGTCACATAAAATCAATGA[A,G]AAATTTAGATTGGCACGGAGATAGG | 2,892,197 | 83 |
| 6847. | TTTTATACGAATCTGATCAAATCA[T,G]ATGTCTTAAAATAGGACTCTTCTAG | 2,892,272 | 83 |
| 6848. | GACGTCCAAGTGCTTCATATATCA[G,A]AGATAGAAGAGGGAGGAGGCATGGA | 2,892,391 | 83 |
| 6849. | CGAACCCACTAAATAGCGTGTCCA[A,G]CACCCTTGGACGTGGAAGTGCTTCA | 2,892,424 | 83 |
| 6850. | ATGCAAATTTGACAGCCTTCGACA[T,C]TTCGAACCCACTAAATAGCGTGTCC | 2,892,451 | 83 |
| 6851. | TCGAAGCTAGATCACAGCCTTCTC[G,A]TTCTTGATGCAAATTTGACAGCCTT | 2,892,482 | 83 |
| 6852. | CAGGACTCCGATCGAAGCTAGATC[A,G]CAGCCTTCTCGTTCTTGATGCAAAT | 2,892,493 | 83 |
| 6853. | TACTCGAGATTCGCTGTTGAGCTA[C,T]GCACGTGACTGACCTCTATAGGCAT | 2,892,640 | 83 |
| 6854. | CCAAATATAGATCTAAATCAGATC[C,A]ATGAACTATTTATATCAGCATATAA | 2,892,769 | 83 |
| 6855. | TGACCAGACGATCTGATGATAAAC[T,C]TTTCCGAATACTTGGCTACTCAGAT | 2,893,112 | 83 |
| 6856. | TCCTTGCTTCTTCTTATGACCAGA[C,T]GAGCTGATCATAAACTTTTCCGAAT | 2,893,128 | 83 |
| 6857. | CCTACACTTCATAAGAGAATCCAT[C,T]GATTGGACAAGAGAGGGATTATTCC | 2,893,175 | 83 |
| 6858. | TTTCACTGTTCTTCTTTATGGGAT[A,G]TAACCATATGGTGTCCCTACACTTC | 2,893,215 | 83 |
| 6859. | ATCAAATACAAATTTCTTTTCACT[G,A]TTCTTCTTTATGGGATATAACCATA | 2,893,232 | 83 |
| 6860. | GATAGACGTGCCAGCAGCAGGTTT[C,T]AAGATTTTATAAAATTTTAGATTTT | 2,893,433 | 83 |
| 6861. | TCAAAAGGACTAAGTTGCCTCGA[T,C]AGACGTGCCAGCAGCAGGTTTCAAG | 2,893,455 | 83 |
| 6862. | ATCACAGGACTGAGCCGACTAACT[G,A]GTGACAAACAGTAACTCGCTAACCG | 2,893,568 | 83 |
| 6863. | ATGATTTATGAAATTATGTCAGAT[C,T]ATGGACTAGCACAAGTTCAACAAGT | 2,893,766 | 83 |
| 6864. | TAGACTTAATTGAGCTACCCACAC[C,T]CTGAACTCATGATTTATGAAATTAT | 2,893,799 | 83 |
| 6865. | ACAACGGAATTAATTAAAAAACTA[C,T]CATCTATGTACTTACCTTAGACATC | 2,894,043 | 83 |
| 6866. | TAATGGTTATAACTAATCTAGTGG[C,T]ATGGACTAGCACAAGTTCAACAAGT | 2,894,193 | 93 |
| 6867. | CGAGAACAATCAACCCTGTAAAGG[A,G]CCCACACAACTACAATGATAGAAAA | 2,894,302 | 83 |
| 6868. | TCTAATAGTTATAGTTGCATCTTT[T,C]CGATGCAACTGAATCACTGTATCCA | 2,894,354 | 83 |
| 6869. | TCTTGTCCAATGTTTCTCTAAACA[C,T]ATTGCAGCCACCTTCGATCTCTAAT | 2,894,546 | 83 |
| 6870. | TTAAGAGTCTTAAGTGAGTACTAC[G,A]GTCTCACCAATTGACTCACCATCTC | 2,894,639 | 83 |
| 6871. | TTAGGGCTCCTATTTTTTTGATTC[T,C]CCACACTCCTTTAGAAGAGAAGCGA | 2,894,701 | 83 |
| 6872. | TTGGAAGCAGACATTGTTCCTGCA[G,A]AGAGTCAAAGTTTCTAATTAAATTT | 2,894,800 | 83 |
| 6873. | GATGCTTTCTGATCAACGATTGGA[T,C]GGATTGGGAGAGGAGAAAGGTCCTG | 2,894,962 | 83 |
| 6874. | ATAAGATGCTTTCTGATCAACGAT[T,C]GGATGGATTGGGAGAGGAGAAAGGT | 2,894,966 | 83 |
| 6875. | CTCATGTTAGTATTGTAATTCTGG[G,A]GACATTGACGTCAATACATAGCACC | 2,895,047 | 83 |
| 6876. | GCAATAGTCATATCCTCATGTTAT[T,C]ATTGTAATTCGTTGGACATTGACGT | 2,895,061 | 83 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 6877. | GTTCATATGAATCAGTCAAAGACT[G,A]CAGGATCAGATCAACCTACAAGTCC | 2,895,291 | 83 |
| 6878. | TCAGTAGACTTTCTCTTGAAAAAA[A,G]TCTACTCCATAGCAAGTACAGAGCC | 2,895,438 | 83 |
| 6879. | GTTGTCTTTGTCACAGTAAAAATA[C,T]TTTCTCTTTTCGACGACCTTCTTCT | 2,895,550 | 83 |
| 6880. | CAGGTAAGTAGGGCAGTTCCATTT[T,C]CAATGGTTGTCTTTGTCACAGTAAA | 2,895,580 | 83 |
| 6881. | AGTGTTGTCAGGTAAGTAGGGCAG[T,C]TCCATTTCCAATGGTTGTCTTTGTC | 2,895,588 | 83 |
| 6882. | ACATCCAACTGGATGTAGAAAAAA[C,T]TGTCAGATTTATTTCTATGACGAGC | 2,895,671 | 83 |
| 6883. | CCTCCTACTATCCTCAAGATCCTG[T,G]AAAGAAATGCACAAATGAGCACTAG | 2,895,733 | 83 |
| 6884. | TAGAATCATTTCACTATCCCTTAA[C,T]CTCCTACTATCCTCAAGATCCTGTA | 2,895,757 | 83 |
| 6885. | ATATTTTTCATTAGTAATCGTAGA[G,T]GATAGGTTTTCACGACCATAGTAGC | 2,895,831 | 83 |
| 6886. | GCGTTAAACAAGATACAAAAATCA[G,A]ATTTCTGCTCGCAGTAGATATAAAG | 2,895,902 | 83 |
| 6887. | ATTTCTTAAATAAATAGCACAATG[A,G]TCCTTAAAGAAATTAATTATATAGT | 2,895,958 | 83 |
| 6888. | ATCATTTCTAACTTTATTATTTCT[T,C]AAATAAATAGCACAATGATCCTTAA | 2,895,976 | 83 |
| 6889. | ATAACTAAAAAAGATCATTAATAA[G,A]AAAATCATTTCTAACTTTATTATTT | 2,895,004 | 83 |
| 6890. | TTTTCGTTCACATTATCTCTAAGA[T,C]GTTTAGAACCTATAGCATTCACATT | 2,896,086 | 83 |
| 6891. | TTAATCTTATCTTCGGCAACATGA[C,T]CTAGCCTTAGGTGCCACAAGTACTT | 2,896,134 | 83 |
| 6892. | TGTCTTGAAGGTATGATTCACAGA[C,T]CGAATATGACTCAGAAGTCAATAGA | 2,896,211 | 83 |
| 6893. | CACCAGAGCAAGTCACTCTATGAT[C,T]CTTTCCCCAAGTCTCACAAAAGACA | 2,896,273 | 83 |
| 6894. | CCACTATGAGATAATTCTATTTTT[T,C]TTGAGATAATTCAAAAATTTTTCAC | 2,896,540 | 83 |
| 6895. | ATGTCGACTCACAATCACATTATG[A,G]TCTTTCGAAAGATAGAAATAATATC | 2,896,864 | 83 |
| 6896. | TTCTAAGGCTCATTGCTCTTTGAA[G,A]ACTTTCTCTTCAAGTCTAATTTGTG | 2,896,960 | 83 |
| 6897. | TTGGTTCCTCAAGTTCTAAGGCTC[A,G]TTGCTCTTTGAAGACTTTCTCTTCA | 2,896,973 | 83 |
| 6898. | ATACACTGCAACAGCAAGCAATGT[A,G]CAGATGGACTTAAGCATAGGTATAA | 2,896,424 | 83 |
| 6899. | TCCTCATTATTGATGAAACCAAAG[G,A]ATTTAATTACATCACTGAACTAAGC | 2,897,648 | 83 |
| 6900. | GGAGAATATCATCTATGTACAATA[C,T]AAAGAAAGTGATAGCACTTCATTTG | 2,897,719 | 83 |
| 6901. | TGTTGGGACACATCATTTTGGAGA[A,G]ATGAATGCCATATCTGAAGGGTACT | 2,897,974 | 83 |
| 6902. | ATAAAGAATCTTGCTTATGCATTC[A,G]ATCTCTTTCGATGTGTTGGGACACA | 2,897,012 | 83 |
| 6903. | GCTCCCTATAACGGAAGCATAAAG[A,G]ATCTTGCTTATGCATTCAATCTCTT | 2,898,030 | 83 |
| 6904. | ACAGTATGAGCGATATTAGGTCGT[G,A]TACAAAGTATGACGTACATGAGGCT | 2,898,077 | 83 |
| 6905. | TTTTGAACCAGAACATCTCCTTCA[C,T]AGCCTCTAATGCGGCGATGTATTCT | 2,898,394 | 83 |
| 6906. | GCATCACTCCAAGTTCTGCAATAA[A,T]TTTTTTGAACCAGAACATCTCCTTC | 2,898,421 | 83 |
| 6907. | CTTTCTCAAGGTAATCGCGGATGA[G,A]GTGAAACCATCGCTTGATGTACTTG | 2,898,550 | 83 |
| 6908. | TCTCACTTGACCTAAAGCTAATTG[G,A]CTACAAATCTAAGTTCCATCTTCTC | 2,898,692 | 83 |
| 6909. | TTTACAGACACTATTAAACATAAT[A,G]TAAATAAAAATAACCCAATTTTATT | 2,898,828 | 83 |
| 6910. | CTTATGATTGAGAGTAATTTATGA[A,G]TTAACTAAGATTAGTATATGTTTCA | 2,898,931 | 83 |
| 6911. | TCTTTTGGATCGATCACCATCTCC[A,G]TGATGATCTTATGATTGAGAGTAAT | 2,898,963 | 83 |
| 6912. | TCAAGACTCATCTATCCGAAGAGA[G,A]TGATCATACATCAATCTTTTGGATC | 2,899,002 | 83 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 6913. | ACTCAGTACTCTTGCTCTTAACAA[A,G]CACCTATACTTTCACTCCGATGTCT | 2,899,065 | 83 |
| 6914. | TTCAATTCTTACAATGAACATACT[G,A]GAGCCAACATACATCTCAAGACTCC | 2,899,274 | 83 |
| 6915. | TTGAAAGATAAACTTCTAGATACA[A,G]TTATCGTGTGATTCGATTCTTCTAT | 2,899,538 | 83 |
| 6916. | GATCCCACAATCCATCAGTGACAC[C,T]CAGCAATATGTAGTGGCAACCTAGC | 2,899,592 | 83 |
| 6917. | AACAACATCATCGAAACTCTTTTC[G,A]ATAGATCAGAACTCTTTTCAATCCAA | 2,899,680 | 83 |
| 6918. | AGCATGATTTTCTTAAATTCAAAA[C,T]TAGGACTCAATTGATCCTAATCCAA | 2,899,836 | 83 |
| 6919. | TTTAACCATGTGCTAGCATGATTT[T,C]CTTAAATTCAAAACTAGGACTCAAT | 2,899,850 | 83 |
| 6920. | CATGGTCGAACAATATTGGGTGGC[A,G]CCAACATTTGACGCCTCGTAAACCC | 2,900,019 | 83 |
| 6921. | CTTTGATTTTCTCTTGTTTTATC[A,G]TACAAAACTAATAAAAAaTTCAGAC | 2,900,294 | 83 |
| 6922. | AACAGAAGGACTCTCTTAGATCCA[C,T]CCTACTTTGATTTTCTCTTGTTTT | 2,900,323 | 83 |
| 6923. | ATGCCTTAAAACAGAAGGACTCTC[T,C]TAGATCCACCCTACTTTGATTTTC | 2,900,332 | 83 |
| 6924. | TATCATAAAGAATCTCTTTTATA[C,T]GAATCTGATCAAATCAGATGCCTTA | 2,900,374 | 83 |
| 6925. | TTCTAGTTTCTTATGCAGTTTTGA[C,T]GGCTTTCGATACTTCGAACCCACCA | 2,900,548 | 83 |
| 6926. | ACCTAGACGGATCCGCAAGCTCCT[C,T]GATCAGATTCAAATCTGATCTCCAA | 2,900,628 | 83 |
| 6927. | CGTCCGACTCACAAGTATCCACTC[G,A]AGCCTGGTCTGAGATGCTCTCTCCT | 2,900,694 | 83 |
| 6928. | ATGCATACGTCCGACTCACAAGTA[T,C]CCACTCGAGCCTGGTCTGAGATGCT | 2,900,701 | 83 |
| 6929. | AGTCCGATAATCAGAGTATCCAAG[G,A]TTCACTGTTCAGCCATGCATACGTC | 2,900,740 | 83 |
| 6930. | AGATCAATAAACTATTTATATCAG[C,T]ATATAAATATAAAACAACATGCAAA | 2,900,835 | 83 |
| 6931. | GAGGCAGTAGAATTCAAAAATTTT[C,T]GATCCGACCCGGTACATCAAACATA | 2,900,895 | 83 |
| 6932. | TAAGAAAGGAGACCGACGGAGACC[G,A]ACGAGAGGTGGCATCAAGCAGAGAA | 2,901,030 | 83 |
| 6933. | AGGTGGCCGTTCGTGAGAGCTCGA[T,C]AAGAAAGGAGACCGACGGAGACCGA | 2,901,054 | 83 |
| 6934. | ACGGACAAAGGGGTGCGGACGGTC[G,A]TCGGTGCTCACACACAACTGCAGGG | 2,901,375 | 83 |
| 6935. | CTTTTAATATCCTGCCAAAGCCAG[G,A]TAAGAAAATAATATTTTAATTAAT | 2,901,854 | 83 |
| 6936. | TTTTATTATCTTATATCAGTGAAT[G,A]ATTAATTTCAACAAAATAATTACAA | 2,902,241 | 83 |
| 6937. | TACACAATATAAAGAATAGAATAC[T,C]AGTTATCATAACAATCATTCAGAAA | 2,902,394 | 83 |
| 6938. | AATGGATTTCTGAAACAACAATTC[A,G]GAGAATATCAACTGCATAGTAATTC | 2,902,564 | 83 |
| 6939. | AACAGTGCAAAAAGAAGCAACAAT[G,A]AATAAGAAAGAACAATTTCACATCT | 2,902,728 | 83 |
| 6940. | ATCCAAAACAAGCTTGTCCAAGC[A,T]CGGTCTATTTAGCAAATTAGTCGAA | 2,902,979 | 83 |
| 6941. | AATTTAAGGGAAAGTAGCTTGTCA[A,G]TAGGGCGAAAGACAAGCAAAGATAT | 2,903,147 | 83 |
| 6942. | ATCAGAGCATAGGTTTCCACAACA[T,G]ACCAACACTATATGCACCAACTTAC | 2,903,240 | 83 |
| 6943. | ACAAAATGCAATGAGCGATCTTCT[G,C]GTTCGTGGCTCTCACAAGGCATGCA | 2,903,299 | 83 |
| 6944. | CTCACTAATTAAATACTTGCAGAG[G,A]CTGGAGACCAGCTCCCACGATGATC | 2,903,369 | 83 |
| 6945. | TAAAAAaTATAAAAATAATAATAT[G,A]AAATATTTTAAATATtTTTTATAAT | 2,903,451 | 83 |
| 6946. | GGAAGAAGAAAAaGATAATAATAA[A,T]AAAaTATTATTTTTTAaAAAaTAAA | 2,903,497 | 83 |
| 6947. | GGTGGCGGGTCCGAAGAAGCAAGG[T,C]CGGGCATAGGAAGGAAGAAGAAAAa | 2,903,534 | 83 |
| 6948. | GGGGACAGAGGAGGCGCAGGTAGC[A,G]CGGACAGGGGGTGGAGGGGGTGGCG | 2,903,577 | 83 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 6949. | GACGTCGGAGGTGGAGGAACCGCA[G,A]GTGTGCAGGGCTAGGGGAGTATTGC | 2,903,986 | 83 |
| 6950. | AAGATTACGATTAATTCATGTCAC[G,A]ATTAAATTAATTTTTTTtCTAAAAA | 2,904,153 | 83 |
| 6951. | ATTTTTTATCATTAAATTAAACAT[G,A]AATTATTTAGATTTCAACTAATTAA | 2,904,240 | 83 |
| 6952. | AGTACTCCGGAAGATATTTTAGTT[C,T]CTTTATTGTTTATCTATTTTTATC | 2,904,280 | 83 |
| 6953. | ATGTGTAATACATGTCCTAATTAA[G,A]AATTTTACTATAGTACTCCGGAAGA | 2,904,316 | 83 |
| 6954. | ACAACATCATTCCTCTTTTCTTTT[C,T]TTTTTTTTAACTATTTTACTTCATT | 2,904,372 | 83 |
| 6955. | CCTTACCCTTACCAGAGCAAGTTC[G,A]TTCCTTTATTTTCTCTTTAGTTATT | 2,904,424 | 83 |
| 6956. | TGCTTTTTCACTTTCTAACCGACA[A,G]CACTTTCATCCTTACCCTTACCAGA | 2,904,458 | 83 |
| 6957. | AAAACAAAATATCTAATTAATATA[G,A]AAAGTTACTCAACAGAATGGAATTC | 2,904,642 | 83 |
| 6958. | AATTATTATAATTTAATCAAAAAT[C,T]AGAAATTGATGGTGAATATGGAATA | 2,905,296 | 83 |
| 6959. | CTCGAACATTTCCTCGTTGTAAGA[A,T]CCAGGTGAGTACTGCAGAGCGCCGT | 2,905,896 | 83 |
| 6960. | AAGCTGATGAGAAGAAGTTGCCAT[A,G]TGATATATGGGCATTATATATATGT | 2,905,948 | 83 |
| 6961. | ATATATATATATATATGAATCAAT[C,A]CATATCTACCCATACCATATGCGTG | 2,906,203 | 83 |
| 6962. | CTAACAAAGGTTAGGGCTTTATTA[A,C]TTGTCAGTGCAAATATCTTGTCATG | 2,915,782 | 83 |
| 6963. | TTGGGAGTGTACCTAACAAAGGTT[A,T]GGGCTTTATTAATTGTCAGTGCAAA | 2,915,794 | 83 |
| 6964. | CCTTCACTCTTACCAACATGATGA[G,C]TGAACCTGACTCTTCTTTTGTTGAG | 2,915,942 | 83 |
| 6965. | CTGATTAATGAATTCCTTCACTCT[T,C]ACCAACATGATGAGTGAACCTGACT | 2,915,956 | 83 |
| 6966. | ATACCATAATATCTTCCATAGTTA[G,A]AAGCACATCAGCTCTCTCAAGATGC | 2,916,057 | 83 |
| 6967. | TAACCAATGTAGAACCAGTGATCT[T,C]CTTTCTTCTATACCATAATATCTTC | 2,916,091 | 83 |
| 6968. | CTTTCTATATAAGCTAAATTTTtC[C,T]TTAACTCTAACCAATGTAGAACCAG | 2,916,123 | 83 |
| 6969. | AAGCCTTGATCATTGAGAGCCTCA[T,C]GATTTTATTCTTTAAAAAGCATCTC | 2,916,191 | 83 |
| 6970. | AATGGTGTTTAGGTGAAAGGAGCC[C,T]CCCACATTCTATTAAAGGCATGTTG | 2,916,312 | 83 |
| 6971. | CTTTGGGAACATAACCTCTCTAGT[G,C]AAAGGAGAATCTGTGTACTCTACAG | 2,916,362 | 83 |
| 6972. | GACTCAAGATCAAGTAGCAGACAT[A,C]TTCACCAAGATATTACCCAAAGAGA | 2,918,771 | 83 |
| 6973. | TGGATGAGAAGCAAGAAGAAGCTA[T,C]TATACTACTTTGTGACAATAAGTTT | 2,918,935 | 83 |
| 6974. | TGTGGATGAGAAGCAAGAAGAAGC[T,C]ATTATACTACTTTGTGACAATAAGT | 2,918,937 | 83 |
| 6975. | TGAGAAGAATACTAGAAGATGTGG[A,G]TGAGAAGCAAGAAGAAGCTATTATA | 2,918,956 | 83 |
| 6976. | AACATCAAAGAAGCAAGACATTGT[G,A]GTATTGTCATCCACGAAAGTCGAAT | 2,919,045 | 83 |
| 6977. | ATCTTGAACATCAAAGAAGCAAGA[C,T]ATTGTGGTATTGTCATCCACGAAAG | 2,919,051 | 83 |
| 6978. | AGTCAAGTAAGGTTCACTTTGGAG[T,G]GGCACAAAGAGTCTTGAGATACATC | 2,919,250 | 83 |
| 6979. | TTCTAGATTCATGCAAAAGTCAAG[T,C]AAGGTTCACTTTGGAGTGGCACAAA | 2,919,267 | 83 |
| 6980. | GAAGTTAATGAAAAAGATGAAAG[T,C]GATGAAGCCAATGCACCACTATATA | 2,919,388 | 83 |
| 6981. | CAAAACGGAGAATTACAATATTGT[A,G]GTAACACCTTTGATGGTAAATGAGA | 2,919,436 | 83 |
| 6982. | AGATAGTATTGTTATTTATCAAAA[A,G]AAGTATGTAGAAAGCATTCTCAAGA | 2,919,490 | 83 |
| 6983. | ACTTTTTAGAAATTGAAATCATGC[T,C]GAGAGAAGATAGTATTGTTATTTAT | 2,919,521 | 83 |
| 6984. | AAAAGTTTTTAAAGAAGTTCAAGT[G,A]AACCAACACTTTATATGAAGAAGTA | 2,919,704 | 83 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 6985. | AATGAGAAAAGTTTTTAAAGAAGT[T,C]CAAGTGAACCAACACTTTATATGAA | 2,919,710 | 83 |
| 6986. | ATTGAAGCCAACTTCAATGAGAAA[A,G]GTTTTTAAAGAAGTTCAAGTGAACC | 2,919,725 | 83 |
| 6987. | GAGGAAAAATTTATATAGAACAA[C,T]CTCAAGGCTTCATCATCAAAGGTCA | 2,919,848 | 83 |
| 6988. | TTCTTGAATGGGATATTGGAGGAA[A,G]AAATTTATATAGAACAACCTCAAGG | 2,919,866 | 83 |
| 6989. | ACAACTAGACCTCTCATTTCTATG[A,G]TGGCATACAAAGATTGGAAACTACA | 2,919,938 | 83 |
| 6990. | TATCCAGAATTAATTATCAAAAAA[A,T]TTTTGCACCGATTGCTCAACATGAC | 2,919,988 | 83 |
| 6991. | AGCAAAATTAGTAGAAAAGGATA[C,A]TCTCAACTATCCAGAATTAATTATC | 2,920,020 | 83 |
| 6992. | GACAAAATACAATCCGGATGGATC[C,T]ATTCAAAGATACAAAGCAAAATTAG | 2,920,059 | 83 |
| 6993. | AGAATAAGACAATGCAAGAAGAAA[T,A]TGATGTGATTGAGAAGAACAAAACT | 2,920,168 | 83 |
| 6994. | ATACATGAAGTAGTATAGAATAAG[A,G]CAATGCAAGAAGAAATTGATGTGAT | 2,920,184 | 83 |
| 6995. | TAAGTGACATTTATGTCACTTGTA[G,A]CTTTTGCATGATTGAGCCCAAAACT | 2,920,246 | 83 |
| 6996. | TATAAGAATAAGAAGCCTAAGTGA[C,T]ATTTATGTCACTTGTAGCTTTTGCA | 2,920,263 | 83 |
| 6997. | ACTCAAGCTTATCTCCAAATTCCA[C,T]TCCTATAAGAATAAGAAGCCTAAGT | 2,920,291 | 83 |
| 6998. | GAAAATGAAGATGAAGGTTCACCA[C,T]AAACTTCTCAAAGTGTAAGTCCATC | 2,920,352 | 83 |
| 6999. | CTATAGACTTTTTAGTTCGAAGCA[C,T]AACAAGATGATCATAAAAAGAGATA | 2,920,498 | 83 |
| 7000. | ATAGTTCTAAATCAAAGGCTATA[G,A]ACTTTTTAGTTCGAAGCACAACAAG | 2,920,517 | 83 |
| 7001. | AGGCACAAACTTGATGAAGTAAGT[G,A]AAAAATATATTTTTGTTGGCTATAG | 2,920,563 | 83 |
| 7002. | AAGCATTTCAAAGTTTTTGGATGT[A,G]TATACTATACTCGTGTTCCAAAAGA | 2,920,617 | 83 |
| 7003. | TCAAATAAATTTGAAAAATTTTAT[A,G]AAAATATTGGTTTGCAAAGATAATT | 2,920,884 | 83 |
| 7004. | AGAGGTGGTGAATATAACTCAAAT[A,G]AATTTGAAAAATTTTATAAAAATAT | 2,920,902 | 83 |
| 7005. | ATGATATGGGCATACTTTATGAGA[T,C]ATAAGTTTGAGACATTCATCATCTT | 2,921,016 | 83 |
| 7006. | TAACTACTTAAAAATGATATGGGC[A,G]TACTTTATGAGATATAAGTTTGAGA | 2,921,029 | 83 |
| 7007. | ACAAGCTTTTCTCTTTTCTTCAAC[C,A]CCCCCAAGAGAACCTAAGCCTCTAG | 2,930,376 | 83 |
| 7008. | TAGCTGCCTGGATGGGTCGGTGGG[T,C]AGCAGTACTTGAACTAAAAGCTGCC | 2,931,419 | 83 |
| 7009. | TTGACTCCCAAGTATCAGACATCA[A,G]AAGTGTGTGATCTTCTCTCTTCTAA | 2,932,446 | 83 |
| 7010. | ATCAGCATCTCTCAGTATACGATA[A,G]AAATCATCACTGCCAGCTTCTAGAT | 3,090,050 | 51 |
| 7011. | GCACAAATTCACTCCTATATAAAT[G,A]GACAGTCATTGTATCCCTATCAAGT | 3,090,244 | 51 |
| 7012. | ATCTCTTATAAGGGCAATAAGTCC[G,A]TCCTTGATGTAAGAGTGCCGCATTT | 3,090,310 | 51 |
| 7013. | AGAAATCATCTTGTCAATTACTTG[A,G]CGGTCCATGACACACTACCTAAGGA | 3,090,407 | 51 |
| 7014. | ACGGTCCATGACACACTACCTAAG[G,A]ATTTTGCACATACAAATACAAGATA | 3,090,431 | 51 |
| 7015. | GATTTTGCACATACAAATACAAGA[T,C]AATTGCTAAATGATTATTTTATTAT | 3,090,455 | 51 |
| 7016. | TATTATTTCGAATGGCTTATATAG[A,T]AATTACATCTTGCCATCAACTAATA | 3,090,499 | 51 |
| 7017. | TCTTGCCATCAACTAATAGGTATA[G,C]AAGGTCTTATCTCGTTCAAAAATTA | 3,090,531 | 51 |
| 7018. | AATAGGTATAGAAGGTCTTATCTC[G,A]TTCAAAAATTATATTAATTCTATAA | 3,090,545 | 51 |
| 7019. | CCCTATCATTTGATTACTGTAATG[A,G]CCTATAAAATTAATTGTATTTCTCA | 3,090,738 | 51 |
| 7020. | CTGTAATGACCTATAAAATTAATT[G,A]TATTTCTCAAATTATCCATACTGGA | 3,090,754 | 51 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 7021. | ATTTCTCAAATTATCCATACTGGA[C,A]AATCAATTGATCAATGTATATAATT | 3,090,780 | 51 |
| 7022. | AATTCTTTCATCTGTATAAGAATA[C,T]ATAAATATATAGATACTGTAGAATA | 3,090,826 | 51 |
| 7023. | AGAATACATAAATATATAGATACT[G,A]TAGAATATATATATTAATTAAAAGA | 3,090,844 | 51 |
| 7024. | ACATGTAGACTTGGGTGCACCAGA[T,C]GACTAGACCGTGCTAGCACACCAGC | 3,091,000 | 51 |
| 7025. | GGGTGCACCAGATGACTAGACCGT[G,A]CTAGCACACCAGCATGGCATCTAGG | 3,091,012 | 51 |
| 7026. | TGACTAGACCGTGCTAGCACACCA[G,A]CATGGCATCTAGGCAAATTCCATCC | 3,091,024 | 51 |
| 7027. | ACTTTAGACCAGGCTTAGGCCCTA[A,G]AATCTTTTAAAATATGAGATCCGAG | 3,091,177 | 51 |
| 7028. | ATCTTTTAAAATATGAGATCCGAG[C,T]CCGGCTCAAACCCAATCAGATCGGC | 3,091,203 | 51 |
| 7029. | ATCCCCAAGGGATAGATATTCTCT[A,G]TCGGAAGTACATTGATCATCGAAGA | 3,091,317 | 51 |
| 7030. | CGAAGAACTCACTAGAAGTACATT[T,G]GTCATCGAAGAACTCACTAAGTTGC | 3,091,361 | 51 |
| 7031. | ACTAAGTTGCTTCCACCACCATCG[A,G]AGTAGATGAGCAGGGTAGAGTCGGT | 3,091,401 | 51 |
| 7032. | GACGCCGTCGCTAATACTCACCAA[G,A]TGGCGCAAAGAAGAAGAGGAGACGG | 3,091,722 | 51 |
| 7033. | TGGCGCAAAGAAGAAGAGGAGACG[G,A]CGYAGAGATTGGGGCGTGGGTCTGA | 3,091,747 | 51 |
| 7034. | AGGATGGTCAATTCGGTGCGGGGA[T,C]ATCAGATCCAAGGAGGGGATGACAG | 3,091,988 | 51 |
| 7035. | TTTTTAGGGCATAGTATTAGTGAT[A,G]GCTAATTTGCATCGCTAAAGTCTTC | 3,092,148 | 51 |
| 7036. | TGATAGCTAATTTGCATCGCTAAA[G,A]TCTTCACTAATACTAATTATTTAAA | 3,092,168 | 51 |
| 7037. | TAAAATTAAATTTATAATGATGCA[G,A]AAAAGATCATCGCTAATAAGTCTTC | 3,092,214 | 51 |
| 7038. | CATCGCTAATAAGTCTTCACCCTT[A,G]TAATGATGGATTTAATTTCCATCGT | 3,092,246 | 51 |
| 7039. | ACCCTTATAATGATGGATTTAATT[T,C]CCATCGTAATAAGTAGTTGATAAAT | 3,092,264 | 51 |
| 7040. | ATTACTATTAGCGATGGCTTATTT[A,G]CCGTCGCTATTACACTATTTTCTTA | 3,092,314 | 51 |
| 7041. | CAAGCAACGGAGTAGTCTTTGAAA[A,G]AATAaTACCCTACAAGCCAATCACA | 3,092,492 | 51 |
| 7042. | GCCAATCACATATGAGATATGATG[A,G]AATTTtTTTtAtATTTTATCTTCCA | 3,092,532 | 51 |
| 7043. | GAAATTTtTTTtAtATTTTATCTT[C,T]CAAACTTATGTATTTGACATTGTTA | 3,092,555 | 51 |
| 7044. | TAGGTCTGGACAATGATTTTAGGA[T,C]CACAATGAGATCACGTCAATGAGAT | 3,092,677 | 51 |
| 7045. | GGATGGTTGATCTTATAACTACTT[G,A]TGTAGTGACACTAATATAAAAATAT | 3,092,835 | 51 |
| 7046. | GAATGAGTTCACTGAATTGACCTA[C,T]GAGAGAATATCTAATGGAGTCTTAT | 3,092,899 | 51 |
| 7047. | GTTCACTTTCTAACTTGATTTTTT[G,A]ATCTTTATGTAGGGTGTTCTGGATG | 3,093,045 | 51 |
| 7048. | TCTGGATGTAGTGAAGTGTGTATG[G,A]AGATTGTGAGTGGTCAATAAGGAAT | 3,093,087 | 51 |
| 7049. | TATGATTTCATGCCTACGGCTCGT[T,C]TGGGATATTGTTTGACTGAAGGATT | 3,093,292 | 51 |
| 7050. | GCTCGTTTGGGATATTGTTTGACT[G,A]AAGGATTGAATTACACAGTAACTTG | 3,093,310 | 51 |
| 7051. | TTTTATCAAATTTTATCTCTTCTG[G,A]ATAGTCATAATATTTTACTAGACGT | 3,093,383 | 51 |
| 7052. | GGATAGTCATAATATTTTACTAGA[C,T]GTTAATATTGATTTATGAACTTATT | 3,093,406 | 51 |
| 7053. | TCAAGAGTTTGTGTCTACTGCTAG[T,C]TAGATTTGAAATCTAATAGATCACA | 3,093,550 | 51 |
| 7054. | GAAATCTAATAGATCACACACTTT[G,A]AAATTTGATCTTGATCTAATTTAAT | 3,093,582 | 51 |
| 7055. | AAAGGTTAATTTGATATGCTAGCA[T,C]ATTGTGTTAACCTAAGTTTCCAATT | 3,093,652 | 51 |
| 7056. | GCTTAGGTCTATTTTTATTGAACT[C,A]CTACCTAACTTGGAAGAGTTTTAAG | 3,093,757 | 51 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 7057. | TAAGAAGAGGAAGAGTCCTTCTTC[T,C]TTAAAGACTCTTATCTATCGCTTTA | 3,093,877 | 51 |
| 7058. | GTGCTACTTAATTCATCAGAGAAA[C,T]AATTTTTCTATGTGAGGGAAGTGGA | 3,094,022 | 51 |
| 7059. | TTTTTCTATGTGAGGGAAGTGGAG[T,C]GTCAAGAGTTGGCACCCCTTGGGTC | 3,094,049 | 51 |
| 7060. | TAAATGGGGTGCCTCTTATGGGAT[A,G]AGGGTTGAGAATTGATAAAAATTCA | 3,094,125 | 51 |
| 7061. | ATGGGATAAGGGTTGAGAATTGAT[A,G]AAAATTCAAAGATCTTGGCATGTGA | 3,094,142 | 51 |
| 7062. | TGTCCTAAGATTTGATTTTTCAT[A,G]TGTTGGAGTACAAAATCAAATCTTA | 3,094,297 | 51 |
| 7063. | TAAGATTTGATTTTTTCATATGTT[G,A]GAGTACAAAATCAAATCTTAGATTA | 3,094,302 | 51 |
| 7064. | AGACAATAGTGCGTTGGTGTGATC[A,G]TTCTTTAAGAAAGAAGCTGGCAGTG | 3,094,402 | 51 |
| 7065. | AGTGCGTTGGTGTGATCATTCTTT[A,G]AGAAAGAAGCTGGCAGTGTTCTTAT | 3,094,409 | 51 |
| 7066. | TTGACAGTTTTAATTGTTAAAATT[T,C]TTTATTTATATATTAAAATTTTTAA | 3,094,671 | 51 |
| 7067. | TTAATTGTTAAAATTTTTTATTTA[T,C]ATATTAAAATTTTTAAAATTCTTAT | 3,094,680 | 51 |
| 7068. | AATTTTTAAAATTCTTATTCTACT[A,G]CATGACCGAAATCTAATAGTCTTGA | 3,094,712 | 51 |
| 7069. | CTGTCCTCACCTTTGGTCCCTACT[T,A]GTCACCTTCCCATCATAGCCTAAGG | 3,094,855 | 51 |
| 7070. | CCTACTTGTCACCTTCCCATCATA[G,C]CCTAAGGGAGGAAGACTGATGGCGA | 3,094,873 | 51 |
| 7071. | TAGCCTAAGGGAGGAAGACTGATG[G,A]CGATAATCCTAATCCTTCTCCTCCA | 3,094,895 | 51 |
| 7072. | CGATGGTCTTAGCTTCATCTCTCG[G,A]TCCCCATTCTCTCACAATATCCTGA | 3,095,074 | 51 |
| 7073. | CTTCACGGTATTTTAGACACTCTC[T,C]TTTGCTTTGGCTTCCTAGCTACCCT | 3,095,225 | 51 |
| 7074. | CACACTTAAATTGTGCAACCTCGA[T,C]GAGTCGGTGGTTATGTCAGCACTCA | 3,095,467 | 51 |
| 7075. | AAGAAGTGAGGCCAAGAAGAGCCT[C,T]ATGTGGGCTTGATGGGAGAAGGGCT | 3,095,669 | 51 |
| 7076. | GGCTTGATGGGAGAAGGGCTCTCT[C,T]GACCATCGAAGAGCCTCAGGTCGAG | 3,095,699 | 51 |
| 7077. | CGGAGATATCTTTACTGACCCTAA[T,C]CGATAAAAACCCCATCGATCAGGAG | 3,095,812 | 51 |
| 7078. | ATACTATTGCTTCTACTATAACCA[T,C]GGTCATAACTCTGAAGAATGTCTCT | 3,095,874 | 51 |
| 7079. | TCCTAATCCATAGAGACTATCTTG[G,A]AAAGTATGTCCGACCGTGTCAGGCC | 3,095,945 | 51 |
| 7080. | CCGTGTCAGGCCCGACCGTCTGAG[G,A]AGCTATCTCAACATCAGTTCGATGA | 3,095,983 | 51 |
| 7081. | ACAGAAGATTTGCTAGGGGGTAGA[C,G]AGATAGTGTGCAGGAAACTTTGCTT | 3,096,074 | 51 |
| 7082. | CAATGAAAACATCCTCTACTGAGT[C,T]TGGCACCTTTTGATTATATCAATAA | 3,096,130 | 51 |
| 7083. | ATATCGCGACTGCAGCTAAGACTT[T,C]CATAATTCTAACCAACGAGGCTCTG | 3,096,397 | 51 |
| 7084. | TGGTCATGAGAAGAAATCCTGACT[C,T]AAGTTAGAACCTCAACAGCAAGACC | 3,096,445 | 51 |
| 7085. | TTCGAACATCCCTATAGGGATCAG[G,A]GTAAGATGATGATGGTAATTTGGCA | 3,096,612 | 51 |
| 7086. | GATCGATTGGATATCGACTTCAAA[T,A]AAGACCTCATCAAGATCTTCTCGGA | 3,096,673 | 51 |
| 7087. | GATCTTCTCGGACATCTCCATAGG[G,A]ATTGGGTTAAGACAATGATGGTGAC | 3,096,711 | 51 |
| 7088. | TATGAACCGATTGGATATTGACTT[C,T]GGATGAGATTTCATCAGGATCTTCC | 3,096,774 | 51 |
| 7089. | AGGATCTTCCCAAACATTCCCATA[G,A]GAACTGGGTTGAGATGACAATGGTG | 3,096,814 | 51 |
| 7090. | TTCCCAAACATTCCCATAGGAACT[G,C]GGTTGAGATGACAATGGTGACTTTG | 3,096,820 | 51 |
| 7091. | ATTGCATCGGATCAATTAGATATC[G,A]ACTTCAGACAAGACCTCATCAGGAT | 3,096,874 | 51 |
| 7092. | TCGGATCAATTAGATATCGACTTC[A,G]GACAAGACCTCATCAGGATCTTTTC | 3,096,880 | 51 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 7093. | TGTAGGGATCGATTAAGACGATGA[C,T]GGTGACTTGGCAAAATTGTCATGGA | 3,097,044 | 51 |
| 7094. | CTTGGCCTCATCGAATGAGTCCAG[G,A]TTCACTATCGACGGTGTTACTCCTA | 3,097,284 | 51 |
| 7095. | CCGGTGTGGGAAATAGGAGTCATT[T,C]AACACAAGCATCAAAAAGGTAACAA | 3,097,436 | 51 |
| 7096. | TTACAAATAAGGCTAGTCGAGGTC[A,C]TTGTACGTGGGTTCGGCAGAATGTT | 3,097,558 | 51 |
| 7097. | GCCTCCCGGGCAGGGCCCCTCACA[A,G]TGTTCTTGGCAGCAAGGCCAGGAGC | 3,097,613 | 51 |
| 7098. | TCCTCGCTAGGACAGACTGGTCCT[T,C]GAGCGAGGCAGGCTCATCTTCGTCT | 3,097,667 | 51 |
| 7099. | GCTAGGACAGACTGGTCCTTGAGC[G,A]AGGCAGGCTCATCTTCGTCTGATGA | 3,097,672 | 51 |
| 7100. | AGCGCCTCTTACAGGCTTCAAAGC[C,T]GTATATGTAGGCCATTGAGAATCAT | 3,097,796 | 51 |
| 7101. | GCAACCTCATCCTTGAACTCTGTC[A,G]AAGCCTTGAATTTCTCAAAGCCCTT | 3,097,849 | 51 |
| 7102. | TCAAAGCCCTTGAGTTTGGCCTCG[G,A]TAGCAACCTTCATTGTCTCCTCTTA | 3,097,888 | 51 |
| 7103. | TTGTCTCCTCTTAGCCTTGGACTT[G,T]ATGAGCTCCACACTATCTTCGGTAG | 3,097,925 | 51 |
| 7104. | GCTCTAGGACCTCCTCAAGCTCAG[C,T]CGCCTTCTGACGAAGTACCCCGATG | 3,097,996 | 51 |
| 7105. | GATGAAGACAATTATGAACAACAA[A,T]GGACTTATGCCGAGTAGACCAGTGT | 3,098,347 | 51 |
| 7106. | ATCCAAGGGATGAGCCTTTCTCTC[C,T]GACTAATCAGTCGGCAGCAAAATCA | 3,098,416 | 51 |
| 7107. | TAATCAGTCGGCAGCAAAATCATC[T,G]TCACCAACTGTCAAGCGAGCTGGTG | 3,098,444 | 51 |
| 7108. | TCATACCTTGTTTGCCTCCTCAAA[G,A]CTAGGAAAGATGGTGGCTATAGGGT | 3,098,579 | 51 |
| 7109. | TGGCCAGTTGATGGGAATGGTGAC[T,C]GAGCTAACTCTAAAATCATCGGTGC | 3,098,681 | 51 |
| 7110. | GGGCTGATCTAAACACATGCAAAA[A,G]AAATGGTTCTTCCATTCATGAACTG | 3,099,205 | 51 |
| 7111. | CAATAATGTTACATCCTAATCAAG[G,A]AAAAAAGTACCACCATCCTCTCTTA | 3,099,627 | 51 |
| 7112. | CTTTGAAGGGAGAACACCTTAGGA[C,T]AATACTGAGCCAGTTATAAAGAATG | 3,099,345 | 51 |
| 7113. | GGAAAGGTGAAGACCAATCCGAAG[G,A]GATTCCTCTTACAATGCGACTCTAC | 3,099,512 | 51 |
| 7114. | AAGCCTGGCTCGAGGAGGCGGTGA[C,T]TGAGAATTCTGACTGCCATGAAGAT | 3,099,797 | 51 |
| 7115. | GAGGAGGVGGTGACTGAGAATTCT[G,A]ACTGCCATGAAGATTTTCACCCTTG | 3,099,808 | 51 |
| 7116. | AAGGAGGAGGATCGATTGGAGACT[A,G]CAATTGGAGATCACCAGCATCAAGG | 3,100,007 | 51 |
| 7117. | ACTAACAGTCAAGATTCAAGCCCC[G,A]TGCCATTAGATTTTGACACCTGACA | 3,100,183 | 51 |
| 7118. | AGATTTTGACACCTGACATGCATT[G,A]AAAATACCAAATCACATGATTCTTC | 3,100,215 | 51 |
| 7119. | TAAAATCACTTCGGACTTGAGAGT[G,A]GGGAATAAGTATTGTAGAGGTTATC | 3,100,577 | 51 |
| 7120. | TAGAGGTTATCCACCATCCGACTC[A,G]ACATCTCCTTCTTAGATTATGATCA | 3,100,616 | 51 |
| 7121. | CGACCTCCTAACCTAGTATCCACT[G,T]ACCTCGAGGGTAGGATCCTCCTAAT | 3,100,757 | 51 |
| 7122. | CTGACCTCGAGGGTAGGATCCTCC[T,C]AATGACGAAGAGCATAGTCTGACAG | 3,100,779 | 51 |
| 7123. | GAGCATAGTCTGACAGACCTATGC[A,G]AGTGTCGATCCGAGGCAGGACCTTG | 3,100,813 | 51 |
| 7124. | ATCCGAGGCAGGACCTTGGCTCAA[C,T]ATGAACTCAGAACATCAGACCATTC | 3,100,845 | 51 |
| 7125. | TCTGTGCTCTTATTCTCCTATTCT[T,C]TTTTCTCCATTATTCTCAGGCTCCA | 3,101,151 | 51 |
| 7126. | CCATTATTCTCAGGCTCCAACTGA[C,T]TTAATGTTGGGATTTGGTGCCTCGA | 3,101,182 | 51 |
| 7127. | GGATGCATGGCCCAGGCATGGGGG[C,T]GGCCCAGCACGAGTGCGCAGGCGCA | 3,101,344 | 51 |
| 7128. | GCCCAGCACGAGTGCGCAGGCGCA[C,T]GACCCAGCACAGGGAATAGGTGCGC | 3,101,370 | 51 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 7129. | AGTGCGCAGGCGCACGACCCAGCA[C,T]AGGGAATAGGTGCGCGCGCGTGGCC | 3,101,380 | 51 |
| 7130. | TCCATGGTGGACCGTGGGAGTTGT[C,T]GTGGTCCATGCGACTGTCATGGACT | 3,101,449 | 51 |
| 7131. | CTTCACGGTCGAATGGCTAAGGAG[T,C]GATTCGGGTGATGTTTTGCATGATC | 3,101,541 | 51 |
| 7132. | CGGTCATGATCAAATGGACAAGAA[T,C]ATTTTTAAGTCCTAATAGAGGTTGT | 3,101,610 | 51 |
| 7133. | TTTCTATCTGCAATGGGTTTTGGA[C,T]GCTTGAGGGGCAGACGGGCCGAAGG | 3,101,661 | 51 |
| 7134. | AGCAGCGACCAGAGCCTCAGGTGG[G,A]GTCGAAAGAGGGTCTTCTTGGTTTT | 3,101,799 | 51 |
| 7135. | TGGGGTCGAAAGAGGGTCTTCTTG[G,A]TTTTTTtATGAGAGCTTTTATAAGA | 3,101,820 | 51 |
| 7136. | ATAAGAGATGAGAGGTGAGAGCTT[C,T]TTATTGAAAGAAAGAGGTTTGAGAG | 3,101,864 | 51 |
| 7137. | GTCAGGCTCAATCAAAGTAGAGAT[C,T]AATTAGTATGATGAAAAAAGTAATT | 3,102,172 | 51 |
| 7138. | CTATAGCAAGCGAGGGTGAAGGAT[G,A]CGCTCATCCAACAGGGATTAATCGA | 3,102,227 | 51 |
| 7139. | ATGAGCGAGGGATAGAGCGTGCAG[G,A]AGCATCTCAGCAACTTTTAAAAGAT | 3,102,492 | 51 |
| 7140. | GCATCTCAGCAACTTTTAAAAGAT[T,C]TTCACTGATCTCCTTAGCATTGGTG | 3,102,518 | 51 |
| 7141. | ACTGCTCTTCTTGTGAAAAAGAGC[G,A]CCATTAGGATGGATTACTTCTATAC | 3,102,638 | 51 |
| 7142. | AAGTAGCAATATAGAAGGCAGTGA[C,T]GATGTTCTTCTAGTGTCAGATGAGG | 3,102,932 | 51 |
| 7143. | ACTGTTCACTTATCGGATAAATTG[A,G]GTTGTGAGATCAAGGACAGTGGGAC | 3,103,080 | 51 |
| 7144. | TAAATTGAGTTGTGAGATCAAGGA[C,G]AGTGGGACGGTTAGCTTACAAGCAC | 3,103,097 | 51 |
| 7145. | TTGTGAGATCAAGGACAGTGGGAC[G,A]GTTAGCTTACAAGCACATGATGGAA | 3,103,106 | 51 |
| 7146. | AAGATCCAATACGTACCCAGCTTC[A,T]GGAATAATCTAATTTCATCGAGCAG | 3,103,173 | 51 |
| 7147. | ATGATGGAATCCTGAAGGTCATGT[A,G]TGGCAGTAGGATTGTGATGAAAGAA | 3,103,254 | 51 |
| 7148. | GAAATTATGGAGGATACTACCTCT[T,A]GGTAAAAAGCTTAGCATGAGATAGA | 3,103,305 | 51 |
| 7149. | TTGGCATCTCGAATTCGATCCATA[G,A]GAGAAAAATCAAAGACAGAGGAGTT | 3,103,676 | 51 |
| 7150. | TGCGCACAGGCCCGCAGCAGGGCA[C,T]GGCTCGCAAGCTTGTGCAGGCCCGC | 3,103,767 | 51 |
| 7151. | CAAGGGTGCGCGCGCATGGCCCAG[C,T]AGGATTTTGGCACGGTTGGACCATG | 3,103,890 | 51 |
| 7152. | AAGGGTGCGCGCGCATGGCCCAGC[A,G]GGATTTTGGCACGGTTGGACCATGG | 3,103,891 | 51 |
| 7153. | TCCATGCGATCGCTGTGGATCGAC[A,G]TGGTGCAGGGAGAAAATATAAAGGC | 3,103,953 | 51 |
| 7154. | TCAGGTGGCTTGCGGTCATGATCA[A,G]ATGGCCAAGAATGTTTGTAAGTCCT | 3,104,073 | 51 |
| 7155. | TAGAGAGTAGTCATCGATAGTGAG[T,C]ACTTGAGAGGCAGAGGAGCTATAAA | 3,104,208 | 51 |
| 7156. | GGAGTTGGTAGAGGATTTTTTtGG[A,G]TTTTTTATGAACGCTTTTGTAAGGG | 3,104,288 | 51 |
| 7157. | AGGATTTTTTtGGATTTTTTATGT[A,G]CGCTTTTGTAAGGGATGAGAGGTGA | 3,104,299 | 51 |
| 7158. | GAACGCTTTTGTAAGGGATGAGAG[G,A]TGAGAGTTTCTTGTTGAAAGAGATA | 3,104,321 | 51 |
| 7159. | TTCATAGTAAAATTTTGCATGTTC[T,C]GTGGAGATAAATCTTGGTATAATCC | 3,104,419 | 51 |
| 7160. | GAGTGCGGACTACTATAGTAGGTT[C,T]CTCTTTTACACTTCGAGCTTCAGAC | 3,104,544 | 51 |
| 7161. | TTATGATGACTTTGATGAAGTAAT[T,C]GAGTGATCGTGGTTTTTtCTTTGGT | 3,104,651 | 51 |
| 7162. | TGGCCCCTAAAGTTGCTCAAATAA[A,G]GATGATAATGGATCAGATATGAATC | 3,105,481 | 51 |
| 7163. | TCAAGATATATAAACCATCCGGTC[C,T]CTTTCAGCCTTTTTGAGCATGGCCA | 3,106,104 | 51 |
| 7164. | AATTTTTGAATATAAAATATATGC[T,C]GGTGATCATCCTGATTGGTTAGATT | 3,106,186 | 51 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 7165. | ACTCTTCTGGTTAGATACGAAAAA[C,T]TAGATCCTAAATTGGCATGATCATA | 3,106,294 | 51 |
| 7166. | GATCCTAAATTGGCATGATCATAA[G,T]CCGATTAGAGAACAAACATCACAAT | 3,106,321 | 51 |
| 7167. | AAGTAATATAACATTTTAAATCAG[C,A]TTATATGGCATACATGATAAAAATC | 3,106,556 | 51 |
| 7168. | TATATATTGATTGGGTCTTAGATA[C,T]ATATACCAGACTAAGTAACTCAAAT | 3,106,669 | 51 |
| 7169. | TTGGTTGGTTGTGCTTTCTACTAA[G,A]ATTTTACATTGTTATAAATGGTATT | 3,106,727 | 51 |
| 7170. | TATCTTTTGGTTGGGATCCTGATC[G,A]TTACAGTGAGCCATCATAAAATCTA | 3,107,010 | 51 |
| 7171. | GTTACAGTGAGCCATCATAAAATC[T,C]AAAAAGGTCTATTACCAATTTGCCT | 3,107,034 | 51 |
| 7172. | AAAACTGTTTCTCTTTGGAAAGCT[C,T]AGGTTGCATCTAAAAATTTTTCTAT | 3,107,367 | 51 |
| 7173. | AATCTACATGAATAAGGATCAAAT[A,C]CTTACTTAATTAGCAGTGGAACCAG | 3,107,418 | 51 |
| 7174. | CAAGGGAGAAGGGGCGGCACCAAA[G,A]GGGAGAGGCTAAGGAGAAGAAGAAG | 3,107,663 | 51 |
| 7175. | ATCAGTCCAATACTCATGAAAGAA[G,A]GATTTCTATATGAGATAAAATTGCT | 3,107,868 | 51 |
| 7176. | ATACTCATGAAAGAAGGATTTCTA[T,C]ATGAGATAAAATTGCTATCACTTAT | 3,107,877 | 51 |
| 7177. | CTATCACTTATGACAACCACTTTG[C,T]ACCCACTCCCTCACCCACATGGGAT | 3,107,916 | 51 |
| 7178. | TTTCAGATGTTGGTCAGCCCATAT[A,G]AGAGAAAAATCTCAGTGCAAATAGG | 3,107,983 | 51 |
| 7179. | TTGAATTTTtGAACTCAATTAAGC[T,C]TAATTAATTTAGATCTAATCTGAAA | 3,108,149 | 51 |
| 7180. | TAGATCTAATCTGAAATTAATCAA[C,T]ACTTAAATTCAATCTTTCATATGCT | 3,108,183 | 51 |
| 7181. | TCCATGGATCATAGATCAGAAACT[G,A]TTCATCCCCAAGATCGAATCTGAAC | 3,108,232 | 51 |
| 7182. | CAGAAACTGTTCATCCCCAAGATC[G,A]AATCTGAACCTCATGTATAGTGCTA | 3,108,248 | 51 |
| 7183. | AAATCCTATCTAGCAATGATTTTC[A,G]ATGTTTAGATAGATCGAATTATCGT | 3,108,504 | 51 |
| 7184. | TTACTGCATAATTCGTCCTTTTGA[T,C]CCTGAATGCTTTAGGATGGTCTCAA | 3,108,584 | 51 |
| 7185. | GGATGGTCTCAAGTTAACTGTCAA[T,C]CAAGATTGTTTCATCCATATTGTAT | 3,108,622 | 51 |
| 7186. | ATGGTCTCAAGTTAACTGTCAATC[A,G]AGATTGTTTCATCCATATTGTATTT | 3,108,624 | 51 |
| 7187. | TTTCAAATCTATCTCATAGATTGT[C,T]CTGATCAAGACTTTGCTAAATTAAA | 3,108,679 | 51 |
| 7188. | TGTTCCCAATAGCCTTCCATCACT[G,A]TATTTAAAATTCAGATAGTCCGACA | 3,108,809 | 51 |
| 7189. | ACTCTTGACAGCAGAATGCTCAGC[A,G]GGTGAGTCATTAGTTCAGTGACAAT | 3,109,455 | 51 |
| 7190. | CATCATCATCCTGTAATGATGTAT[C,T]ATTTGATCACAAATATGTTTAAGAA | 3,109,606 | 51 |
| 7191. | AATGATGTATCATTTGATCACAAA[T,C]ATGTTTAAGAACTATACGATAAATC | 3,109,620 | 51 |
| 7192. | AATTTTATTCAATAATTAATATT[C,T]ATATACAAAAAAATTTAATCGTCA | 3,109,763 | 51 |
| 7193. | TATTCAATAATTAATATTCATATA[C,T]AAAAAAATTTAATCGTCATCCGAT | 3,109,769 | 51 |
| 7194. | TTTAGGATATAATTTTCAACAACT[C,T]CCATTTTGACTAAAGCTAATCAGGA | 3,109,823 | 51 |
| 7195. | TGAAGTCATCGAACTCTTTGATCT[T,C]GAGAGCTTTAGTGAAGGGATCGGCT | 3,109,898 | 51 |
| 7196. | AGTGAAGGGATCGGCTAAGTTCTC[T,C]TTTCCATCGATCTTCTGAAGTTTGA | 3,109,932 | 51 |
| 7197. | TGTGATGGTGTGACTTTGATTCTT[C,T]TGTCTAAGCTATGGCACTGAAGCTG | 3,110,039 | 51 |
| 7198. | TCTGTCTAAGCTATGGCACTGAAG[C,T]TGTCACAGTATAGCAGAATAGAGCC | 3,110,062 | 51 |
| 7199. | GCCATCAATAGAAGATGTAACTCC[T,C]AGCTCGTGATCAATTTTTGCAACCA | 3,110,109 | 51 |
| 7200. | TTTGCAACCATACCATCTTCTTTG[C,T]AGCATCCAATGTAGCAATGTATTCT | 3,110,149 | 51 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 7201. | TCCATTCATGATAAATACATAATC[C,T]GATACGCTTCTACTGTCATCACAAT | 3,110,258 | 51 |
| 7202. | TCATGATAAATACATAATCCGATA[C,T]GCTTCTACTGTCATCACAATCTGAC | 3,110,263 | 51 |
| 7203. | AGTGTCTCCATAGATAAGCCATTG[G,A]TCTTTAGTATTTCTCAAATACTTAA | 3,110,351 | 51 |
| 7204. | GAATTGCTTTCACAATCTTTCAAT[G,A]CTTCTCATCCAGATCAGAATGGTAC | 3,110,401 | 51 |
| 7205. | ACAATCTTTCAATGCTTCTCATCC[A,G]GATCAGAATGGTACCTACTCACTAT | 3,110,412 | 51 |
| 7206. | AGCATATGGTATTCTACTCATGCG[C,A]TCTCTCTCCTTAGGAGTTGTCGGAT | 3,110,528 | 51 |
| 7207. | TCTCTCTCCTTAGGAGTTGTCGGA[T,C]ATTCTTTTTGGAAAGAGTAATTTT | 3,110,553 | 51 |
| 7208. | GTCGGATATTCTTTTTGGAAAGA[G,A]TAATTTTATGGTCTATTAAAAAATA | 3,110,571 | 51 |
| 7209. | GAAAGAGTAATTTTATGGTCTATT[A,G]AAAAATAGTCTTTTTtAAAATTATC | 3,110,589 | 51 |
| 7210. | CACAGCTTCATACTCTGCAAAGTC[G,A]GGATGTCATTTTCTAGTAATAGTAC | 3,110,781 | 51 |
| 7211. | TCTCCGTTCCTAACGAAGTCATAC[A,G]TTTTGGTCACCTTATCAAAATGCAT | 3,110,898 | 51 |
| 7212. | AGCTTGCTTAAGTCCATAAATAGA[T,C]ATTTTTAGCTTGTACACTTTTGACT | 3,110,963 | 51 |
| 7213. | GCTTGCTTAAGTCCATAAATAGAT[A,C]TTTTTAGCTTGTACACTTTTGACTC | 3,110,964 | 51 |
| 7214. | CCTCTTCTTTCAGCTTTTCATTAA[G,A]GAAAGCGATTTTGACATCCATCTGC | 3,111,052 | 51 |
| 7215. | TTGAGTATTGCCACAGGAGAGAAC[A,G]TCTTGTTATAGTCAATACTATAATG | 3,111,153 | 51 |
| 7216. | TGACGGTATCCTTTGATAATTAGA[C,T]GAGCTTTATAGGTCTCTACCTTTCT | 3,111,204 | 51 |
| 7217. | TTATTTACATCCTATGAATTTTAT[C,T]TCTTCAGATGGATTAACTAGTGTCC | 3,111,281 | 51 |
| 7218. | CTAGTGTAACTACACCATTGATCT[C,T]TATGGACTCCATCTTAGATTTTATA | 3,111,322 | 51 |
| 7219. | ACTCCATCTTAGATTTTATAGTCT[C,T]AAGCTATTTCTGAGAGTCGGGCCTT | 3,111,352 | 51 |
| 7220. | ATCTTAGATTTTATAGTCTCAAGC[T,C]ATTTCTGAGAGTCGGGCCTTTACAT | 3,111,357 | 51 |
| 7221. | TACTCTATCGGATCTTCTTAATGG[T,C]ACTTCTACTGGCTCCAAATTTGATT | 3,111,506 | 51 |
| 7222. | AATCAAATTCAATTCTATATGTGT[T,C]GGTCCTTCCACCTTATAAACTTCAT | 3,111,560 | 51 |
| 7223. | CCACCTTATAAACTTCATCAAGTT[T,C]AATTTTACAGGCATTAGCTCCATCA | 3,111,592 | 51 |
| 7224. | ATAGTATCCTTTAATTTTCTTTGG[G,A]TACCCTACGAACAAACATCTATCGG | 3,111,710 | 51 |
| 7225. | GTATCCTTTAATTTTCTTTGGGTA[C,T]CCTACGAACAAACATCTATCGGATT | 3,111,713 | 51 |
| 7226. | TGACATAAGCTAGATACCCCCAGA[T,C]CCTAAGGTGTGAGAGCACCAGCTTA | 3,111,793 | 51 |
| 7227. | TTGCTGGGCACCTTATTAAAAATG[A,G]AGCAAGCAGTTTTTAGAGCATATCT | 3,111,882 | 51 |
| 7228. | GAGCATATCTCCAAAAGGTGATTG[G,A]CAGACTCATAAAGCCCATCATAGAT | 3,111,922 | 51 |
| 7229. | ATAGATTAAACTATGTCTAAAAAG[A,G]TTCAATTTTCTTCTCCAATCAGCC | 3,111,966 | 51 |
| 7230. | AATACGCCATTATATTGTGGTGTT[T,C]CAGGAGGGGTCCACTGTAAGAGAAT | 3,112,008 | 51 |
| 7231. | CTTAATACTCTTTCTAGTTTGTTT[C,T]TCTACTTCAGCATGGAATCGTTTAA | 3,112,127 | 51 |
| 7232. | GTTTCTCTACTTCAGCATGGAATC[G,T]TTTAAACATTTCAAATAATTTTGAC | 3,112,147 | 51 |
| 7233. | TTATACTTCATAAGACAGACAAAT[T,C]CATACCTCGATAGGTCATCTGTAAA | 3,112,197 | 51 |
| 7234. | TTATGTATATATTATATTTTAATT[A,G]TCCACGTATAATGACAGTATTATTC | 3,112,564 | 51 |
| 7235. | ATTATAAACTTGTAATTAAGTTTG[A,G]CCAAAAGGCCTACAGAGATGACATT | 3,112,641 | 51 |
| 7236. | ACATGATACTACTAGACTCGAAGA[T,C]AAGCTGCAAGGTTTCCAAGGTCAAA | 3,112,726 | 51 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 7237. | GCTGCAAGGTTTCCAAGGTCAAAA[T,C]TGGAACAAGACTTTCATCTCCAACG | 3,112,753 | 51 |
| 7238. | TCCAACGTTAAGGAACCGCTCGTC[C,A]TCTCAAAACTATCTACTTACCTGTA | 3,112,796 | 51 |
| 7239. | GAGAAATTACAAGAAGTTATCATA[T,C]AAGTATCTTGTGAAGCAATCGATTG | 3,112,917 | 51 |
| 7240. | AAGATGATTCTTTTTtAATGACC[T,C]AGCTTCTTACAGAAGAAGTACTCTA | 3,113,018 | 51 |
| 7241. | AGCTTCTTACAGAAGAAGTACTCT[A,G]CTTGGCTCTTGTCAACTTTTGATAA | 3,113,043 | 51 |
| 7242. | TCCTTCTCAAAAGTCTGCAGTAAC[T,C]CTAGCAAATTATGGTAGTTCACTGC | 3,113,217 | 51 |
| 7243. | AAGTCTGCAGTAACTCTAGCAAAT[T,C]ATDDTAGTTCACTGCAGGCTTCGTC | 3,113,227 | 51 |
| 7244. | GGTAGGATTTTGATAGCGAATTGA[A,G]GAGATCATCCTTGCCTAACTGTTCA | 3,113,302 | 51 |
| 7245. | TCCTTGCCTAACTGTTCATGTAAC[G,A]GAAAGCCAAATTTACTAAGGCATTC | 3,113,334 | 51 |
| 7246. | CGCACACGGGCATTGAATACTGCG[T,C]AGGAGGTTTTATATCTCTCTGCATC | 3,113,433 | 51 |
| 7247. | AATGAGCTCTTCTGGCTTTACATC[C,T]TCGAACTTACGATTAAGTTCGTCGT | 3,113,516 | 51 |
| 7248. | GCTACCTTCATCACACAATGCATA[A,G]TCATGCGGTTATTAAGCCACTTCAT | 3,113,571 | 51 |
| 7249. | TTCATCACACAATGCATAATCATG[C,T]GGTTATTAAGCCACTTCATATAAGT | 3,113,577 | 51 |
| 7250. | ACTTCATATAAGTATCTCTCACGG[T,C]ACGAGGAGCATTGGCTGCAAGTTTT | 3,113,614 | 51 |
| 7251. | TGCAAGTTTTTTGGATGCCTCATC[C,T]GTAAGGACATATACAATCCTCTTGT | 3,113,654 | 51 |
| 7252. | TACCAGCTGTCGAAGTTGGGTCCA[A,G]TAAGCTTGTCGCTGTCCAACAGCGT | 3,113,730 | 51 |
| 7253. | CAAAGATATGGACTTTAGTCTAAA[G,A]ATTTTTTtACTATTTTTACGAATTG | 3,113,851 | 51 |
| 7254. | TAGGTTCATAATCAATTATTTTTt[C,T]AAATAATTTTTAGTAATTGGATTTT | 3,114,014 | 51 |
| 7255. | ATTTTACCCCAAGCATCCCTTCAG[T,C]AGGCGTGTGGCGCCTTCACTGAAAA | 3,114,059 | 51 |
| 7256. | GAAGGTACATCATGATGGTCATAT[G,A]ATGAATGATAATTCCAATACGTAAT | 3,114,205 | 51 |
| 7257. | CTCCAATGCCTATTTAAAATATTG[G,A]ACTCATTATCATACATCTTAATAGG | 3,114,275 | 51 |
| 7258. | TCATGACTTTATCACTTTATGGAC[C,A]TAATAATTTAGAAGATTTGATTTCA | 3,114,344 | 51 |
| 7259. | GATAACCTGCAAACTGCAAATTCT[C,T]CCACTGACTTCATTAAGTCATGCAA | 3,114,417 | 51 |
| 7260. | TTCTCCCACTGACTTCATTAAGTC[A,G]TGCAAAGGATTAGACACAAGTTGGT | 3,114,437 | 51 |
| 7261. | CAAAATATAATCTACTATGTTGGT[C,A]AGATAAATGAGATCAGTGGGAGGGA | 3,114,561 | 51 |
| 7262. | TTAACTCACCGTAGATGCATCTAG[A,G]TGAATAGCTCCCAATTAAAAATCAC | 3,114,618 | 51 |
| 7263. | ATTCAAAGCTTAATTCATAATTAA[T,G]TGTATGAAATATGTGTTTCAGTCTG | 3,115,004 | 51 |
| 7264. | AATAAATTTTATAATATGTTTAA[C,T]AATTAAACATACATAGGTATGATCT | 3,115,110 | 51 |
| 7265. | GGTATGATCTAAACTTCATACATA[C,T]ATCTCATGCATCATGATAACTTTTA | 3,115,150 | 51 |
| 7266. | CTAAACTTCATACATACATCTCAT[G,A]CATCATGATAACTTTTCGATTAATA | 3,115,158 | 51 |
| 7267. | ATCATGATAACTTTTCGATTAATA[C,T]CGATTACATCTTATGTAATATGCAA | 3,115,184 | 51 |
| 7268. | GAATTTTATCCTATTATAATAAAT[T,C]ATAAATTATTTTAGATCTAATCTAA | 3,115,260 | 51 |
| 7269. | ATCCTATTCTAATAAATTATAAAT[T,C]ATTTTAGATCTAATCTAAATATATT | 3,115,267 | 51 |
| 7270. | TAATTTTATATATAATTACATCAA[T,C]ATATAATTATTGATAAAATAATTTT | 3,115,507 | 51 |
| 7271. | ATTTTAATAAAATCTATTTTCGT[A,G]CAGTGCTGAATTTCAATAGAATTTA | 3,115,739 | 51 |
| 7272. | TCTATTTTCGTACAGTGCTGAATT[T,C]CAATAGAATTTAGATCTAAATATCT | 3,115,752 | 51 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 7273. | CATCTAATCCAATCAAAGTTAGAT[C,A]AAAAAAAAaTTTATACAAATAGATTC | 3,115,989 | 51 |
| 7274. | GATTTAATATCTCATAAAAAATCT[C,T]AGTTACATCTTATGTAATTAATCTC | 3,116,045 | 51 |
| 7275. | GACCTGCTCTGATACCAATTAAAG[G,A]GAAGGAAAACTATTTCTCTTCAGAA | 3,116,126 | 51 |
| 7276. | CTCTGATACCAATTAAAGGGAAGG[A,G]AAACTATTTCTCTTCAGAAGGCCCA | 3,116,132 | 51 |
| 7277. | TtATTAATCTATATAAATAAAGAT[C,T]AAATTTTTACCTAATTAGTAATAAA | 3,116,200 | 51 |
| 7278. | TAATCAAATGAAGGAGGAGATATA[T,C]TGGTGTGACACCTCACACTAGCAGG | 3,116,374 | 51 |
| 7279. | GTGGAATGCCCAAGGAGGGCCCAC[G,A]CCCAAGGAAGAAGGGGCGGCACCAA | 3,116,423 | 51 |
| 7280. | TATTTATAAATAAATTTTATGACC[C,T]AATAAGTATAGGCATTCTAACTTAA | 3,116,595 | 51 |
| 7281. | GAATCAGTCCATGAAATAAGAATT[G,C]CTACATGAGATAGAATTGTCATCAC | 3,116,654 | 51 |
| 7282. | ACCAGCACCATTTTAGGTGTTGGT[T,C]GGTCCATATGAGAGGAGAATCTCAA | 3,116,754 | 51 |
| 7283. | GAGAGGAGAATCTCAATGCAAATA[A,G]AATTTTTCATATCTCATCCCAAATG | 3,116,788 | 51 |
| 7284. | ATCCCAAATGGATCCGATTTGAAT[C,T]CAATTCGAAGCAGGTTCGAAATAAT | 3,116,828 | 51 |
| 7285. | TCCGATTTGAATCCAATTCGAAGC[A,G]GGTTCGAAATAATTTTGAAAGGCTA | 3,116,840 | 51 |
| 7286. | GCAGGTTCGAAATAATTTTGAAAG[G,A]CTATTAATCACAAACTCTTTAGAAC | 3,116,862 | 51 |
| 7287. | AAGTCTAACTTAAATTTTTAGATT[C,T]AATTAAATATAATTAATTTAGATCT | 3,116,921 | 51 |
| 7288. | CAACTCTTCAATTCTATTTGACCC[A,C]TAATTTAATTTTTCAATCAAGTTAG | 3,117,091 | 51 |
| 7289. | TATTTGACCCATAATTTAATTTTT[C,T]AATCAAGTTAGCTTATATGCTTAAT | 3,117,105 | 51 |
| 7290. | TTTCTATTTTGTCTGACTTATGTG[C,T]GTGACTCCATAGGTTCCAACACTAA | 3,117,201 | 51 |
| 7291. | AGTCGGTAACATAAGAATCAATTT[T,C]TGTACTAATCGAGATACCATCTAGC | 3,117,250 | 51 |
| 7292. | CTAATCGAGATACCATCTAGCAAT[A,G]ATTTTTGATATCCAGATAGATCAAA | 3,117,279 | 51 |
| 7293. | TGCTTCACGAGCAGCTCTTGACAG[C,T]AAAATACTCAGTAGATGAGTCACAT | 3,117,581 | 51 |
| 7294. | ATCTCATCTGTATGCCATATCAGT[A,G]TCACCACACTCTTTGGTTAAGAAGA | 3,117,654 | 51 |
| 7295. | CTCTTTGGTTAAGAAGACAACCAA[T,C]CTATATGGCACACAACGACCTCTAC | 3,117,687 | 51 |
| 7296. | TACGATAAATCTTTTTTTtATCAT[G,A]CACTAACATAGTTTTAAGGACTTTA | 3,117,798 | 51 |
| 7297. | TTTTtATCATGCACTAACATAGTT[T,C]TAAGGACTTTATTATAGCACAAGAG | 3,117,812 | 51 |
| 7298. | TTTGTAATGAAAAATATCAGAATA[A,T]TTTTTATTCAATAATCAATAATTTA | 3,117,879 | 51 |
| 7299. | TAATCAATAATTTATATACAAAGA[G,A]AAATTCAATCATCACACGATTAATT | 3,117,915 | 51 |
| 7300. | AACATAATTTCCAACAGACTCTTC[G,A]ATGCTTAAATCAATTAGAGTTTTAG | 3,117,969 | 51 |
| 7301. | GACTGTAATCTGACAAGGGGATGT[C,T]GGATCGGATGGATAACCCCTATAAC | 3,118,506 | 51 |
| 7302. | ATCACTATACTAGACTTCAATCAA[T,C]GACCCAACCTTCTCTCTAGAAGTTT | 3,118,616 | 51 |
| 7303. | ATACTAGACTTCAATCAATGACCC[A,G]ACCTTCTCTCTAGAAGTTTAATTGC | 3,118,622 | 51 |
| 7304. | CTCTTGGGGCATCATTAATATGCT[G,T]CTTCATAAATCTTGTCACATTTATG | 3,118,690 | 51 |
| 7305. | ATCTTGTCACATTTATGAGGGCTG[A,G]ATGGCTTGAAGTATGGTGCCACAAT | 3,118,723 | 51 |
| 7306. | CTTTTAGATCCCATGTCGCACCCC[G,A]TCGATTACCCTATGTGGCTTAATTT | 3,118,838 | 51 |
| 7307. | CATCACAGTTGATCGAAGGAGGGC[T,C]TTTTGTCATTACCATCTTCCTCAGC | 3,119,077 | 51 |
| 7308. | CTCTTTCTCTTTCTCGTCTCTTCA[A,G]TTTTTTTTtGCGTCCAGTAGCTTCT | 3,119,239 | 51 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 7309. | TtGCGTCCAGTAGCTTCTTCCTCT[A,G]TATGTCTTCTGATAGTAGTGAGGCT | 3,119,271 | 51 |
| 7310. | TCGATCCCTTAGACCATGATGTAC[A,G]AGTAGCCCCATATGCAGGTTTAGAG | 3,119,426 | 51 |
| 7311. | TCATCTTCTCGATGAAGGAAAAAT[T,C]GCCTTTTTCCTGTGTAGGATCTTTC | 3,119,549 | 51 |
| 7312. | TAAATTTTAAATTTTtATCCTATG[C,T]TATTTTAGATCTAATGTCTATTAGA | 3,119,624 | 51 |
| 7313. | TTAAATTTTtATCCTATGCTATTT[T,C]AGATCTAATGTCTATTAGATCTAAT | 3,119,630 | 51 |
| 7314. | AAATTTTtATCCTATGCTATTTTA[G,A]ATCTAATGTCTATTAGATCTAATTT | 3,119,632 | 51 |
| 7315. | ATCCTATGCTATTTTAGATCTAAT[G,A]TCTATTAGATCTAATTTTATTATCT | 3,119,640 | 51 |
| 7316. | CATACCTCAAGGGTAATCTAATTA[T,C]CCTGTAGATGATCGCAGTACTGCTT | 3,119,736 | 51 |
| 7317. | CTGCTTGAGGTTCTGATGTAGCCA[C,T]GCAAGCACCTGGCCTCTACCAGTAT | 3,119,780 | 51 |
| 7318. | TGCTTGAGGTTCTGATGTAGCCAC[G,A]CAAGCACCTGGCCTCTACCAGTATC | 3,119,781 | 51 |
| 7319. | AGGTTCTGATGTAGCCACGCAAGC[A,G]CCTGGCCTCTACCAGTATCCACTCA | 3,119,787 | 51 |
| 7320. | TATCCACTCAGGTAGGATCTGGAA[C,T]ATCTTCTTCTCATGATTCTATGCTC | 3,119,827 | 51 |
| 7321. | TGATAGAAGAATAACCCTTTTATT[T,C]ATTTATAGTCAAAATTATAATTTTG | 3,129,037 | 51 |
| 7322. | TTATAGTCAAAATTATAATTTTGT[T,C]CTTAGATTTGTACAGAAATGTGTCA | 3,129,064 | 51 |
| 7323. | CTTTGATTTCTACTCTATCCCTTC[A,T]TCTATAATATTTTTGACTTCTATAA | 3,129,248 | 51 |
| 7324. | GTTTAGCTTGGTCTAGGGCAATCC[T,C]CACTTGTCTCCTAATAAAGATAAAT | 3,129,550 | 51 |
| 7325. | TCCTCACTTGTCTCCTAATAAAGA[T,C]AAATTTTTATCCTTCTTGAGGATGA | 3,129,571 | 51 |
| 7326. | GAGCCACTGGTGGTTGAGCCATTG[A,C]GGTCCGTTGTGCCGATGACTTCAGA | 3,129,977 | 51 |
| 7327. | GGAGTTGGTGAAGATGACTTTGCT[G,A]TTGGTTGATTGATCAGAGAGGAGGG | 3,130,262 | 51 |
| 7328. | AGATTATTGGTGCTTCTTGTGCCA[A,T]CCTCCTCAGGGTGAGTATTTCATCT | 3,130,327 | 51 |
| 7329. | TGAGGGTTTGGTTGGTTTCAACTG[A,G]GCAAAACTTTTGCTAGAGATAAAAT | 3,130,459 | 51 |
| 7330. | AGAGGAGAAGGTGAAGGTCATCAC[C,T]GAGGCCAAATTCAAGGGCATCGAAA | 3,130,806 | 51 |
| 7331. | TGAGGGCTTCATGGTGGCCTATCT[G,A]TACGATTTCAAAGCCTATAAGTTGC | 3,130,892 | 51 |
| 7332. | ATTGAGAATGCCATGGGGGCACT[T,C]CAAAGGAGACCGTCAATCATACTAT | 3,131,071 | 51 |
| 7333. | TTCTAATGAAATGAATTTCCTCTT[G,A]TTATCTTTTGATGCTTGTATTGAGT | 3,131,207 | 51 |
| 7334. | AAGTCGATGAGAAGTTGATCCATG[A,G]TAATTTTTGCCAAATCTCCATCATC | 3,131,503 | 51 |
| 7335. | TAATGTTTGCCAAATTGCCATCAT[C,T]ATCTTAACCCGATCCTTAGAGGGAT | 3,131,740 | 51 |
| 7336. | AAAAGATCCTAATGAAGTCGCAG[T,C]CGAAACTGATGCCAAGTCGATCTGT | 3,131,794 | 51 |
| 7337. | CATTATTGTCTTAACCCAATCCCA[G,A]GAGAGACTTTTGGGAAGATCCTAAC | 3,131,864 | 51 |
| 7338. | CTATCATCGTCTTAATCTAATTCT[T,A]TGAGGGATGTTCAAAAAGATCCCAA | 3,131,969 | 51 |
| 7339. | AGTCAATTCAAAGTCAATCAGTGG[C,T]AATTTTTGTCAGTCGTCATTGTCGT | 3,132,256 | 51 |
| 7340. | GGTAATTTTTATCAAATCACCATC[C,A]TCATCTTAATCCGATCTCTAGAGAG | 3,132,489 | 51 |
| 7341. | GATCACCATTATAAAGGTCTTAGT[T,C]GTAGCCAAAATATCTTCATGAGGTC | 3,132,621 | 51 |
| 7342. | ACATGAGGAGCCCGAAAATACAGT[C,T]TGAAGGCCTAGGCATGCAGCCTGCA | 3,132,837 | 51 |
| 7343. | CCGAAAATACAGTCTGAAGGCCTA[G,A]GCATGCAGCCTGCAGCATGCACGGC | 3,132,848 | 51 |
| 7344. | AAAATCATAGTGCATAGGAGGATT[T,G]GTGCGATCCAGCGGTCAGGAAGGCA | 3,133,086 | 51 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 7345. | GCATAGGAGGATTTGTGCGATCCA[G,A]CGGTCAGGAAGGCATGCGATCGTGA | 3,133,097 | 51 |
| 7346. | GCATGATCGAAAGTTGTATTATGT[A,G]ATCGGATGGCCAAAAGCGCTTGTGG | 3,133,162 | 51 |
| 7347. | ATTATGTAATCGGATGGCCAAAAG[C,T]GCTTGTGGCAAAGATCGAATGGTCA | 3,133,179 | 51 |
| 7348. | AAAGAGTTTGGAGAGGCTGTGGAG[C,T]AGAGGTGAAGCAGCTTGATGTCAGT | 3,133,290 | 51 |
| 7349. | GCATTAGGAGCAGCTTGTGTGTAG[T,C]TGCAAAAGTAGTCGAGAGTGTCCTA | 3,133,355 | 51 |
| 7350. | AGTAGTCGAGAGTGTCCTAGAACG[A,G]TCATGGGAGTGACCGTCAGTATAGG | 3,133,386 | 51 |
| 7351. | AGGGTCTCCTTGTGGGATTTTATA[T,C]GAGCTTTTATGAGTGTTGTGCATGT | 3,133,524 | 51 |
| 7352. | TCTTTCTACTGCAACAAGTGGTAC[C,T]AGATCTCCAATAATTGGTATCAGAG | 3,133,726 | 51 |
| 7353. | AGCGTCAGCTTGTTCGAACTGTGG[T,G]GGTATTGATCAAGATTGAAGAAGAT | 3,133,808 | 51 |
| 7354. | GTATTGATCAAGATTGAAGAAGAT[G,A]GAGAAGTCAGGTATAATCATGGTGG | 3,133,834 | 51 |
| 7355. | TACTCTCTTGTGTAAAGAGAAGCC[G,A]TCTACCAAAGAAGATGTCAGTGGGA | 3,133,909 | 51 |
| 7356. | GTGTAAAGAGAAGCCGTCTACCAA[A,G]GAAGATGTCAGTGGGAGCCCAGTAT | 3,133,918 | 51 |
| 7357. | AGAAGCCGTCTACCAAAGAAGATG[T,C]GAGTGGGAGCCCAGTATGAGGTGGA | 3,133,926 | 51 |
| 7358. | TCGACCCCATGTTTGTCCATCTAT[G,A]AATAGCTGGCGTATGACTCAGGATG | 3,134,105 | 51 |
| 7359. | CATGTTTGTCCATCTATGAATAGC[T,A]GGCGTATGACTCAGGATGTGGGGC | 3,134,112 | 51 |
| 7360. | TATGAATAGCTGGCGTATGACTCA[G,A]GATGTGGGGCAAGAAGATCCAAAA | 3,134,126 | 51 |
| 7361. | AGATAGAGATAGTTGAGATTTGGT[A,G]CCTTGAATTCGATCTACAACAGAAG | 3,134,212 | 51 |
| 7362. | CTACAACAGAAGAGAAGCCCAGAT[T,G]TGGAGAAATTCATATGCGAGGAGCC | 3,134,250 | 51 |
| 7363. | GAAGCCCAGATTTGGAGAAATTCA[T,G]ATGCGAGGAGCCTAAAAATGCAGTT | 3,134,263 | 51 |
| 7364. | CCTAGGTGCGTAGTGTGTGACGTG[A,C]GTGGCCCAGCGGGGCCTGCTGCACT | 3,134,343 | 51 |
| 7365. | GGTGGACCGTTGGAGGAAGTCACG[A,G]TCCACACATGTTCTATGGACCATCA | 3,134,489 | 51 |
| 7366. | ACCAAGAAGGCATGCGGTCATAAT[C,T]GAATGGCGATCGAGTGTGATCGGGG | 3,134,591 | 51 |
| 7367. | GCATGCGGTCATAATCGAATGGCG[A,G]TCGAGTGTGATCGGGGCTGTATTG | 3,134,600 | 51 |
| 7368. | AGTGTGATCGGGGCTGTATTGCA[T,C]GATCGATGGCCAGAAGCGCTTGCGG | 3,134,628 | 51 |
| 7369. | TGATCGGGGCTGTATTGCATGAT[C,T]GATGGCCAGAAGCGCTTGCGGAAAA | 3,134,632 | 51 |
| 7370. | TCTAGATTGGTTTGGACCCTATAA[A,C]AGAGTTCAAAGAGGTTGTGGAGCAG | 3,134,732 | 51 |
| 7371. | GCAGCCGAGAGTATCCTGGAATAG[C,T]CGTGGGAGTGATCATGAGTGTAAGG | 3,134,855 | 51 |
| 7372. | GCCGAGAGTATCCTGGAATAGCCG[T,C]GGGAGTGATCATGAGTGTAAGGACG | 3,134,858 | 51 |
| 7373. | TGGGAGTGATCATGAGTGTAAGGA[C,T]GAGGCTGAGACATGATGTAGTGGCT | 3,134,882 | 51 |
| 7374. | GTGAGTGCTCTCCTTTTGTACTTG[T,C]TATTTTCTCTCATAGTAAAGCTTAG | 3,135,073 | 51 |
| 7375. | TATTTCATCTCTTCTTTTTTCTG[T,C]TGCAACAAATGGTACCAGATCTCCA | 3,135,253 | 51 |
| 7376. | TCGATCTCATCCTTGAGCTAGAGG[C,T]ATTTCTCGATGTCGTAATTAGGCTC | 3,135,698 | 51 |
| 7377. | TATTCAGCCTACTTCCCTGTGGCC[C,T]GAGCCTCTTTTGTCTATGCATATTT | 3,135,997 | 51 |
| 7378. | GAGAGGATCATCGACAAAAGGCAT[T,C]GGAGTTATATGCTCTTATTCTAGCC | 3,136,428 | 51 |
| 7379. | GCCATTCTCTTCTTCCTCATTAAT[T,C]GAGTTAATCACCCTTCCTCTGGTAT | 3,136,475 | 51 |
| 7380. | AATTGAGTTAATCACCCTTCCTCT[G,A]GTATCCATCTATTGCTGCAAGATTC | 3,136,496 | 51 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 7381. | ATTGATGTGGCTGAGGATGGATAT[C,G]ATTTGGGGACCGAGATGCCAAAGAA | 3,136,555 | 51 |
| 7382. | TTTATTACCTCTTTATATAAAGGT[G,A]AAAATTTATGTTGTCATGCTGGAAC | 3,136,769 | 51 |
| 7383. | TGCTGGAACTTAGTAGGCTATTTG[A,G]TCCTAATTTTCTAGGCTGCTAGGTC | 3,136,810 | 51 |
| 7384. | AGGCTATTTGATCCTAATTTTCTA[G,A]GCTGCTAGGTCTCAATCTGATATAC | 3,136,824 | 51 |
| 7385. | GGAGGTTGGATAGAAACCGATGAC[G,A]TAAAGCTGCTTTGCCTTGGTTTCTC | 3,137,118 | 51 |
| 7386. | CAATTGAAAGTTTAGTGAAATAGG[A,G]CTTGGACAATAAAGGCCTTTACGGT | 3,137,423 | 51 |
| 7387. | GGGGGGAGTTGGGGTCTGAAATGG[A,G]AATGACAATGGATAACTCTCATTCT | 3,137,537 | 51 |
| 7388. | ATTCTGAAGTGGAATGAAAATGAT[C,T]GAATCCCCCTAAAACCCAATCCTCA | 3,137,623 | 51 |
| 7389. | TATTTCAATTTCGATTCTAGTTTC[A,G]ATTTCGATTGTAAATTAAACACCCT | 3,137,779 | 51 |
| 7390. | ACTGCTTTTGTCACTAAAGTCTTA[G,T]gTTAGCATATGTTAACTTGTTTTGG | 3,138,088 | 51 |
| 7391. | ACTGGGCAACATGGATGGCCAAGC[G,A]TTTACATGCCTATAAACAAATCAAG | 3,138,286 | 51 |
| 7392. | TGGGCAACATGGATGGCCAAGCGT[T,C]TACATGCCTATAAACAAATCAAGAT | 3,138,288 | 51 |
| 7393. | TTAGAACTACTTTGATCGATAAAG[A,G]AAGATTTATCGTGTAGTCCTTAAAT | 3,138,868 | 51 |
| 7394. | TGATCGATAAAGAAAGATTTATCG[T,C]GTAGTCCTTAAATTGGTTTATGACC | 3,138,880 | 51 |
| 7395. | TATAGGTCGTTGTGTGCCATATAC[G,A]TTGGTTGTCCTCGTAACCAAATGGT | 3,138,968 | 51 |
| 7396. | AAATGGTGTGGAGATACTGGTATG[G,A]CATGCGGGTGAGATATAGAAGTACA | 3,139,011 | 51 |
| 7397. | CTAACTGAGTTTCTAATTCAGTGA[C,T]GAAAGATTTTTAGTTACAATCAAGT | 3,139,195 | 51 |
| 7398. | CGAAAGATTTTTAGTTACAATCAA[G,A]TACTTATGAAGTTGGTGTATAAGTC | 3,139,219 | 51 |
| 7399. | CAAGTACTTATGAAGTTGGTGTAT[A,G]AGTCAAGATGGGATTGATCCCTTCG | 3,139,240 | 51 |
| 7400. | CATGTGATGGATTTAAAAAAAaTT[G,A]AAATACAATGTGGATGACTTATCTA | 3,139,351 | 51 |
| 7401. | TCGATCTATCCGGATGTTGGGTCA[C,T]CATTGCTAGATGATTACATCGATTG | 3,139,506 | 51 |
| 7402. | ATCATGCGGCTGATCAACGATTGA[G,A]AATCGTTCAAGGGCTTAATCATCAA | 3,139,630 | 51 |
| 7403. | AAGGGCTTAATCATCAATTCGATT[A,G]ATGGTTAACCTTATGCAAAAATTAT | 3,139,663 | 51 |
| 7404. | ATTAAATTATTGATTAGCTTAGTT[T,C]GATTGAGCAAAGAGGATCAAATAAA | 3,139,763 | 51 |
| 7405. | ATTATTGATTAGCTTAGTTTGATT[G,A]AGCAAAGAGGATCAAATAAAATCTA | 3,139,768 | 51 |
| 7406. | TTAGTTTGATTGAGCAAAGAGGAT[C,T]AAATAAAATCTAATTGAGTTGGATT | 3,139,781 | 51 |
| 7407. | AAAGGAGAATTATCCCTGATTTAT[C,T]AGGATTTTGATTCAATCAATTTCTA | 3,139,875 | 51 |
| 7408. | TCATATATTTTATTTGGGCTAAAA[C,T]AGACATGATTTGGTTTGGATTCAAA | 3,139,963 | 51 |
| 7409. | ATATTTTATTTGGGCTAAAACAGA[C,T]ATGATTTGGTTTGGATTCAAATAAG | 3,139,967 | 51 |
| 7410. | TGGATTCAAATAAGGAAATTAAGA[G,A]TCCTTATTGGAATAGAACTCTTCTT | 3,140,003 | 51 |
| 7411. | GTTTTGTATAAAATTTTTTATG[T,C]CAAAGAGTGCTTTCCCTTCTCTATC | 3,140,098 | 51 |
| 7412. | CTCACATCTAAATTTGAATAGGAT[T,C]AGATTTTAAATGGTGTGTTCAAATC | 3,140,147 | 51 |
| 7413. | GTGCTACATTTTAAGGATATTTTT[T,C]ATGAAAAATTATTTGGAGAACTATT | 3,140,280 | 51 |
| 7414. | GTGCATAAAAAATTAGGTTTCTAGG[A,G]TTTTGGTCCTTAGGGTTTGAGAAGA | 3,140,591 | 51 |
| 7415. | GCTAGCACTTTCGAGAAGATCGAT[T,C]AGATCGAGGCTTCAAGTAGATTTTT | 3,140,783 | 51 |
| 7416. | CCTACCTATCAGCAAAACTTGGGA[A,G]TGTGGCGGAGGCTCGGCCGCCCGGG | 3,152,554 | 51 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 7417. | ACTTGGGAATGTGGCGGAGGCTCG[G,A]CCGCCCGGGAGGTTTGAAGAGATGT | 3,152,570 | 51 |
| 7418. | CCCGGGAGGTTTGAAGAGATGTTG[T,C]CGGAGGTCGAAAGTCAGTTGGATCC | 3,152,570 | 51 |
| 7419. | CCCGGGAGGTTTGAAGAGATGTTG[T,C]CGGAGGTCGAAAGTCAGTTGGATCC | 3,152,598 | 51 |
| 7420. | CTATAGCTAAAACTATCAACGAAA[C,A]GATATAATTTTGTAACTTTCTTTAC | 3,152,857 | 51 |
| 7421. | GCTTCGGTTGTAAACAAAGCAACT[T,A]TATCTTGAAGTGTAGTTTTCTAACT | 3,152,932 | 51 |
| 7422. | ATATATTAAGCTACCAACTATACC[G,A]GTATGTAGAACACATGATATGTGCT | 3,153,229 | 51 |
| 7423. | TATGTAGAACACATGATATGTGCT[G,T]TACCTCCTCCATCATTTGCAATGAT | 3,153,255 | 51 |
| 7424. | TTTGAGATAAATACAATCGACCTG[T,G]GCTTATCTCTATAAATTTATGTCTC | 3,153,398 | 51 |
| 7425. | TCCAAATTTTTCATTTTAAATTCA[T,C]CATTCAATATAATTAAAGTTTCAAC | 3,153,467 | 51 |
| 7426. | TCTGCATGCTTCGAGATCTCCACT[A,T]TATAAAATGGTCCAATTTTGGCTCT | 3,153,571 | 51 |
| 7427. | TGGATGTGTGAAAAATGTAGTAGT[A,C]TCACACTATATATTGTTTAACAGAA | 3,153,689 | 51 |
| 7428. | AAGTGGTATAAGGTGAAGCCAGAT[G,A]TGGAGGAGTCTAGTTGGCTATTGCC | 3,154,528 | 51 |
| 7429. | ATCTATGCGGATGTATATTTAATC[T,C]CACATTAATTATTCACCGAAAGATC | 3,154,947 | 51 |
| 7430. | TTTAATCTCACATTAATTATTCAC[C,T]GAAAGATCTTGAATACTTATATAGG | 3,154,964 | 51 |
| 7431. | GGATGAGGTCCTAAATTATTATAC[T,C]TAGCTAATTAGGTATGCAACTCCAT | 3,155,053 | 51 |
| 7432. | TATGCAACTCCATCCAATCTTTGT[A,G]GCATATGCAGGGTGGATGTCTGGCC | 3,155,090 | 51 |
| 7433. | TCCATCCAATCTTTGTAGCATATG[C,T]AGGGTGGATGTCTGGCCAGAACACC | 3,155,098 | 51 |
| 7434. | AAGAAAGAAGAAATAAACAGAAAA[C,T]AATCAAATACGTGGATCAGCCAAAA | 3,155,187 | 51 |
| 7435. | TGGGGCATGCAAACTTCACTATGA[A,G]AAAATAAATATTACAAGAGGAGATC | 3,155,525 | 51 |
| 7436. | GTTCACTATTTCCTGGTTTCCATG[C,T]GAAGACGTCCACGCCCATGAAACCA | 3,155,469 | 51 |
| 7437. | CTCCTAATCAACCTCAAATCAAGT[T,C]CCAAACCGTTGGATCAAGATCAGGA | 3,155,549 | 51 |
| 7438. | TCGCACTCCGATCTATGAAATAGT[G,A]CCGTGGACCGTAAGAAATAGATGAG | 3,155,662 | 51 |
| 7439. | GGACCGTAAGAAATAGATGAGAAA[C,T]GGCTCTGCGGTCCACGTGCTCCTCT | 3,155,691 | 51 |
| 7440. | CTGCCGTTGCTCCACCGGCCCGCC[A,G]CCGGCCGCCGATGGTCCTCCACCAC | 3,155,947 | 51 |
| 7441. | TTCAAACGTATGTATCTCCTCCGT[C,T]CGAGCTCTGTTTGAGATGATCTTGG | 3,156,015 | 51 |
| 7442. | TTCACTGTGAGCTCAATGTGGATT[G,A]AATTTTGAGGCATCAAATCCTAACA | 3,156,095 | 51 |
| 7443. | AATCAACTGCTGATCATAGATTGA[T,C]AAATATAGGAGTCGAGCCAGGCCAC | 3,156,223 | 51 |
| 7444. | GCTGTGCTTCTCCTAACTTAAGAC[A,C]TGCTCGGGGTATCATCCTACAGCAA | 3,156,294 | 51 |
| 7445. | ATAGCCTCTTGAATTCAGTCTGCT[T,C]AATGAGATAAGATTTCATCTAAAAT | 3,156,575 | 51 |
| 7446. | GCTTAATGAGATAAGATTTCATCT[A,G]AAATCAGATATGTATCGAACCTCCC | 3,156,596 | 51 |
| 7447. | AATCAGATATGTATCGAACCTCCC[C,T]CAATCTTCTTACTGCACCATCATGT | 3,156,622 | 51 |
| 7448. | GTCCTCTAGCTGACCATCCCGATG[T,G]CTCTGATAGCGCAGCTCGATCTATC | 3,156,672 | 51 |
| 7449. | CGATCTATCCGACAGATAAATAGT[A,G]TCTTCACTGTTCTCTAAGGAGTCAA | 3,156,713 | 51 |
| 7450. | GCAGAATCTAATATCCACTGTTGG[G,A]AAGAAGTAGATACCTCGTCAGATGG | 3,156,798 | 51 |
| 7451. | CAGATGGCTCCAAGATATCTCCCT[C,T]TGAATTGTTACTGGCCGTCGCCACA | 3,156,841 | 51 |
| 7452. | TCCAAGATATCTCCCTcTGAATTG[T,C]TACTGGCCGTCGCCACAGCAGTCAT | 3,156,849 | 51 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 7453. | AATTGTTACTGGCCGTCGCCACAG[C,T]AGTCATCGTCTGATTTTTGAATTGA | 3,156,868 | 51 |
| 7454. | TGTTACTGGCCGTCGCCACAGCAG[T,C]CATCGTCTGATTTTTGAATTGAGAG | 3,156,871 | 51 |
| 7455. | AACTCGTCACACTGGTAACACCTG[A,G]TCTTGCTCAAGTCTCTCATGGACTT | 3,156,942 | 51 |
| 7456. | AAGTCTCTCATGGACTTGGACCGC[T,C]CTCGTCGCGATCTCCTATCACACCA | 3,156,975 | 51 |
| 7457. | GGACCGCTCTCGTCGCGATCTCCT[A,G]TCACACCATCTACTGCCTCCTGCTC | 3,156,992 | 51 |
| 7458. | TCTTGATGGTGCTCTTCTCCACTA[G,A]AAGAGCAGTCACCAAGGACTCGTAC | 3,157,144 | 51 |
| 7459. | GAGAGACTTCGCTATATACAACTC[C,T]TCGAGCTTCAACCACAGCACCATTG | 3,157,367 | 51 |
| 7460. | GATCACCACCTCATCCGTCAGGAA[C,T]ATGTGGATGGTACTCACTGCCTGCA | 3,157,439 | 51 |
| 7461. | TCTCATTAGACTCTGTTTTTAATC[A,G]CGGACCTCGCTGTAGAATTAATATA | 3,159,053 | 51 |
| 7462. | ATTAATATAGATCAAATCTCAAGA[C,T]GTCAAATcTTAACGACATATGCTTT | 3,159,094 | 51 |
| 7463. | AGATCAAATCTCAAGACGTCAAAT[C,T]TTAACGACATATGCTTTTATACCCA | 3,159,102 | 51 |
| 7464. | TTTATACCCATCCAATCTTTGTGG[C,T]AAGCTCCAACCTACGTGTTTTCATC | 3,159,142 | 51 |
| 7465. | TCTTTGTGGCAAGCTCCAACCTAC[G,A]TGTTTTCATCGAGAACTTGCACTAC | 3,159,157 | 51 |
| 7466. | GGCTCTTAAACCCCTGGACTGGCT[G,C]AAAATGGTTGGCCCTACTTTAATCT | 3,159,221 | 51 |
| 7467. | AGAAGAAGAGACGGAGAACGTTGT[T,G]CTCTTCTCTCTCTTCCTTTTATTTA | 3,159,820 | 51 |
| 7468. | TTTAAAATTTTTTTtCACTAGATT[A,G]TTTTCTCTAGGAGTCTCGTAGACTA | 3,159,985 | 51 |
| 7469. | TAGATTATTTTCTCTAGGAGTCTC[G,A]TAGACTAGTGGAGGGTCCAAGTACT | 3,160,003 | 51 |
| 7470. | TTAAATTTTAGTTGACCGTAGGAA[G,A]AGTCCTGGATTTATAATATTAGGAT | 3,160,062 | 51 |
| 7471. | AAATTTTAGTTGACCGTAGGAAGA[G,A]TCCTGGATTTATAATATTAGGATCA | 3,160,064 | 51 |
| 7472. | TTTTATTTCGAGTTCATAGATCGA[G,A]GAGTTCATCGATTTCTGTATATGGG | 3,160,214 | 51 |
| 7473. | GTATCATATGTTTATATCAAACAA[C,T]AATTATTTTTCGGATGGTTTGGGAT | 3,160,477 | 51 |
| 7474. | GACATAAATTAAGACTTAATAAAT[G,T]GATGATCAAGAGAGGATATTTGAAC | 3,160,571 | 51 |
| 7475. | ACAGATGCGTGGTATTTGAATTTT[T,C]CACTTTAAGCTGAAGCACAGTTATT | 3,160,757 | 51 |
| 7476. | CATGATCGTGATTAGTCCAAAATT[C,T]TAAAGATAATTATAGATTAATCCAG | 3,160,920 | 51 |
| 7477. | CCAGATTAAGTTAATGAGATATGG[G,A]TGATAAGATATAAACCATGATTAAG | 3,160,966 | 51 |
| 7478. | TGAATTGAGGTCGATAATGATTAT[A,G]TTATATTGAGATTGTAAGAAATTTT | 3,161,406 | 51 |
| 7479. | TTACTCTACCACGTGTGTTGAAGA[C,T]AAAGCCAATGAAAAACATAACATCG | 3,161,826 | 51 |
| 7480. | ATAAGAGAAATTGTTAGTTAGAAT[T,C]GTTCTACCATGTATATCTTAGACTA | 3,161,911 | 51 |
| 7481. | GATGTGTTGATTTTTtATTGAATA[A,G]TCTAAGGTACACATGACAGAGAACA | 3,162,120 | 51 |
| 7482. | TTTTTtATTGAATAATCTAAGGTA[C,G]ACATGACAGAGAACAATACTAACCA | 3,162,130 | 51 |
| 7483. | GCACATTGTTTATATGATTGGTC[T,A]ACATAGCCACCACTTCTCAATGCAT | 3,162,464 | 51 |
| 7484. | AATATCCTATGGCATATTATGACT[G,T]CTTATACGCCGGATGTCATAATATG | 3,162,520 | 51 |
| 7485. | TGCATGCAAGATGTCATAATATAG[A,G]CCAAGATGTTATAATATAGAAGAGG | 3,162,631 | 51 |
| 7486. | ACGACAAAAATACCCTTGCTCTTT[G,A]AAAAAAATTATGATATCCTGCGTCA | 3,162,752 | 51 |
| 7487. | TTGTTTCTCTACAGACCATTGAAG[C,T]ACCAAAAAGGGGTTGATGTTGAAGA | 3,163,550 | 51 |
| 7488. | CTGGGAGATAAAGCCACCTCAGGT[T,A]ATCCGAAATACAAATCAAAAGTTG | 3,165,060 | 51 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 7489. | AGGATTTAAAAAGATATATCCACC[G,A]GAGACAAAAGGATGCTCACCGCGCT | 3,165,708 | 51 |
| 7490. | CGCTCTTCGTATGTTTCTGATCTT[T,A]GTATGTAAGTAGAGGCAAACAAGGA | 3,165,754 | 51 |
| 7491. | CCTCAAAGGTATGAATAACTCTAA[A,G]TGCTCACTCTCTCCCATTTGTTCTC | 3,165,805 | 51 |
| 7492. | TTTTAACTTGAGCATTGGAGAGTC[T,C]CCACTGGAGTCATCTCCAGCTAGGG | 3,165,858 | 51 |
| 7493. | ACTTTATTTGCAGATCCTACTATC[A,G]TCGTTCTCGCCGAACCTCGATCTAC | 3,165,908 | 51 |
| 7494. | TCCAGAGCGGACAATATCTCACAG[T,C]AGAAGCTGAGGGGGATGGGGGTAGG | 3,166,195 | 51 |
| 7495. | GAGCGGACAATATCTCACAGTAGA[A,G]GCTGAGGGGATGGGGGTAGGAATT | 3,166,199 | 51 |
| 7496. | GAGTCATGTTAGAGTGGAGGGTGA[C,A]TCCCTTACTGTCATCCGTTGGATCG | 3,166,935 | 51 |
| 7497. | ATTGCATATAAAATCTGAAAAaAA[T,C]TAAATATAAAATCAGCATGCATGCA | 3,167,965 | 51 |
| 7498. | CTTTTTTCACACCATGAAACCATA[C,A]CCAAGACTCCTCTCAATGTGAAGAC | 3,168,418 | 51 |
| 7499. | GTTGGCGACAAGGTGTTAGAGATA[A,T]TGTCAAACATTATCTATATGATATC | 3,168,725 | 51 |
| 7500. | TAAAACCTGCTCGTATCTAAATTT[G,A]GATGTGAGATAGAGAAGGAAAAGGA | 3,168,805 | 51 |
| 7501. | AAGAACCTATTGGCGTATGGTTCC[A,G]TATAATTCATTTCTTTGATCCTAAT | 3,169,554 | 51 |
| 7502. | GTTCCATATAATTCATTTCTTTGA[T,C]CCTAATACTTGAGGACAATCAAAAA | 3,169,573 | 51 |
| 7503. | TTTAGAGGAGTCAATCCCATCTTG[G,A]CTCATGTACTGACTTGACAAGTACT | 3,169,747 | 51 |
| 7504. | GAGTCAATCCCATCTTGGCTCATG[T,C]ACTGACTTGACAAGTACTTGACTGC | 3,169,754 | 51 |
| 7505. | TCTTAGATTCTTTGGAATATCCTA[T,C]AAAATAATACATATAGAATTGAGAT | 3,171,596 | 51 |
| 7506. | TATCAAACTATATCTAACAAAGTT[G,A]ATTTCAATAAGAGAGAATCTTATTT | 3,171,846 | 51 |
| 7507. | CATCGGAAGGACATTCTCCTCTTT[G,A]TTCTGATCGAAGAGTTTCAATGCTC | 3,171,918 | 51 |
| 7508. | AATTTATTTTCTATCTTATTATG[G,A]AATTATTTGAATATTTTAAATAATC | 3,171,973 | 51 |
| 7509. | TATGTTCGTATATCCAATACATCA[A,G]TATGTATCAGACTCAGAACACTATT | 3,172,038 | 51 |
| 7510. | CATGATCGAGCCTAAATTGCCAAA[A,G]ATAGGCTTCTAAGATATAATCTACT | 3,172,212 | 51 |
| 7511. | TCTTAGTTGTCCACATGATTTTGA[T,C]ATCATTCATAATGATATCACAAAAA | 3,172,322 | 51 |
| 7512. | AGACAATAGTGACAATCACCAAAA[T,C]GATATTGATAGAATTGAAAATAAGC | 3,172,377 | 51 |
| 7513. | TGATAGAATTGAAAATAAGCTCAA[C,T]GATTCTTAAAATCAGGATTAAAACA | 3,172,407 | 51 |
| 7514. | ACCGAGACAGTAGTGTTATAGATA[G,T]AGAAATCACAAGGTGTTATTATATA | 3,172,556 | 51 |
| 7515. | TGATTTTCTTCCTTAGCCTGTTC[G,A]TATCAAGGAACTCTATCAGACTAGA | 3,172,631 | 51 |
| 7516. | CTCCTTCAACATTTGAAGGATTTC[C,G]TCCTACTGAATATTAACAAATTTAC | 3,172,809 | 51 |
| 7517. | CAACATTTGAAGGATTTCCTCCTA[C,T]TGAATATTAACAAATTTACAACTAA | 3,172,815 | 51 |
| 7518. | TTCTTTGCTGCTCTCAAAATACAA[C,T]ACATAGTGATACGATCATTTGGCCA | 3,172,872 | 51 |
| 7519. | AGAACTATTTGCAACTTCTGATAC[C,T]ATATATCAAAGTTGGGTCCTATAAA | 3,173,016 | 51 |
| 7520. | ACTATTTGCAACTTCTGATACCAT[A,C]TATCAAAGTTGGGTCCTATAAATAA | 3,173,019 | 51 |
| 7521. | AAAaAACTCAAGACCTCTATGTTT[A,G]TGAATTGATTAAGCCTAAAGACTTG | 3,173,121 | 51 |
| 7522. | ATCCACACAAACTGCATACAAGTC[T,C]GAGGATAGTTCTGTCAACTCATATG | 3,173,266 | 51 |
| 7523. | CTATGGGTAGATTCTCAACTAATT[A,G]TTTCTTCAAACAATTTCTAGTAATT | 3,173,319 | 51 |
| 7524. | TTCTCAACTAATTATTTCTTCAAA[C,T]AATTTCTAGTAATTAATTTTATCCC | 3,173,330 | 51 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 7525. | GCGATAGATCTCCACTAAAAGTTT[C,T]AGTTAGATCAAACCATTAACATGTA | 3,173,397 | 51 |
| 7526. | CATAAATTATGATATTATTTACTA[G,A]CGTATTAGTTAAATACCATGATAGT | 3,173,790 | 51 |
| 7527. | ACTCCATCAGGTCGGATTTTGGAT[G,T]GTTGCAGATCGACACTAAAAAGGG | 3,174,898 | 51 |
| 7528. | CTAAGATCATAAAGTTCAAGAGGA[A,C]CAGCCACTAATCCACATTCAACCAA | 3,174,966 | 51 |
| 7529. | ATTCCTTGAGAGTCCAATCCTACA[T,A]GCTATGCTAATTTCCATGGTTTTG | 3,175,479 | 51 |
| 7530. | CAATCCTAAATGGTTACAACACAA[C,A]TCCAAGCTATTAAGATACGATTCAC | 3,176,060 | 51 |
| 7531. | ATCCCCTCGTCGCCTGGTCACCGG[G,A]AACAAGTGCCTGCAAAAGAAGTCCG | 3,176,852 | 51 |
| 7532. | TCGCCTGGTCACCGGGAACAAGTG[C,T]CTGCAAAAGAAGTCCGCACTGACCG | 3,176,861 | 51 |
| 7533. | CCCTCCGACGGTCAAGTCAGAGAG[G,A]AGACTAGGCAACAGTAGAAAAGAAT | 3,176,930 | 51 |
| 7534. | GGGGGAGAGAGAGGGTAAGCCCAA[A,G]GGTTTCAAAAGAACCTCCTCCAGCA | 3,176,997 | 51 |
| 7535. | TTTTATAGTAGAGCGTGGTATGGC[T,G]CCGTCATTAATGGCACAGACAATGA | 3,177,061 | 51 |
| 7536. | GAGTCGCCGTGGGGCTGTCAAATC[A,G]TCGTGGGGCTGTCAAATCACTAGGG | 3,177,140 | 51 |
| 7537. | TTTGGGTGGAACGATGTCCCAGGG[T,C]GGCTACGCCGCATGACTTTGTCAGG | 3,177,201 | 51 |
| 7538. | GTTTGGGAGAGCTGGCCGACCATA[C,T]GTCGGTATTCGCTGTCGGGACGTCG | 3,177,277 | 51 |
| 7539. | GGTGCCTTGCTTAAGTCGGACGTC[G,A]GCTGCCACCTCCGACGGTGAGTCGG | 3,177,359 | 51 |
| 7540. | CAGTTGCCCCCCcACTCCTGAGTC[T,C]GATGTCATGTTGGCTCGCGTGAATA | 3,177,618 | 51 |
| 7541. | CCCCCcACTCCTGAGTCTGATGTC[A,G]TGTTGGCTCGCGTGAATACGTGGGC | 3,177,625 | 51 |
| 7542. | TCAACGAACGATCCGATGTCGGTC[A,G]TCTCGACTGTAGGTCGAGTGAGCAC | 3,177,736 | 51 |
| 7543. | CATTCCGCAAAGTCGAGTAGCGTC[T,C]GACATATTCAGATAGGATAACGATG | 3,177,834 | 51 |
| 7544. | GTGGTAAGCCGAATATCCTTCGAC[C,T]GATCGTGACCAAGTCGGTATGTCGC | 3,177,947 | 51 |
| 7545. | TAGCATGTCGAGTCGTATGATAGA[T,C]GGTGGCAAGCCGAATATCCTTCGAC | 3,178,017 | 51 |
| 7546. | AAGCCGAATATCCTTCGACCGGTC[A,G]TGACCGGGTCGGTATGTCGCAAGTC | 3,178,048 | 51 |
| 7547. | CGGGTATGTCGCGGTTGTCTTGGC[G,A]TTTTGCCCTTTCTTAGTCGAAGCTA | 3,178,127 | 51 |
| 7548. | TAAGTTGGCAAGTTAGCCAGCCGC[G,A]TTGGTCGAAGCTTTTTGCCCTCAGA | 3,178,175 | 51 |
| 7549. | CATAGGCCGTCGGTTCGGTGATCG[A,G]TGATCGAGCTGTTGATTCGACGATC | 3,178,227 | 51 |
| 7550. | CGGTTCGGTGATCGATGATCGAGC[T,C]GTTGATTCGACGATCGACGATCGAG | 3,178,237 | 51 |
| 7551. | GATTCGACGATCGACGATCGAGCC[A,G]TATTGGTCGAGGCCCTTTTGCTTTC | 3,178,265 | 51 |
| 7552. | CCATATTGGTCGAGGCCCTTTTGC[T,C]TTCAGAGGTCGAGGCCGTCTGTTCG | 3,178,287 | 51 |
| 7553. | TTGCTTTCAGAGGTCGAGGCCGTC[T,A]GTTCGGCGATCGGTGATCGAATCGT | 3,178,307 | 51 |
| 7554. | GCGATCGACGATCGAGCCATATTG[G,A]TCAATGCCCTTTTGCCTTCAAAGGT | 3,178,364 | 51 |
| 7555. | TCAATGCCCTTTTGCCTTCAAAGG[T,C]CGAGGCCGTCGGTTCGGCGATCAGT | 3,178,389 | 51 |
| 7556. | GTCGAGGCCGTCGGTTCGGCGATC[A,G]GTGATCGAGCCGTTGATTCGGTGAT | 3,178,412 | 51 |
| 7557. | TCAGTGATCGAGCCGTTGATTCGG[T,C]GATCGACGATCGAGCCGTATTGGTC | 3,178,434 | 51 |
| 7558. | CCTTTTGCCTTCAGAGGCCGAGGC[A,C]GTCGGTTCGACGATCGATGATCGAG | 3,178,570 | 51 |
| 7559. | TCAGAGGCCGAGGCAGTCGGTTCG[A,C]CGATCGATGATCGAGCCATTGATTC | 3,178,580 | 51 |
| 7560. | CCGAGGCAGTCGGTTCGACGATCG[A,G]TGATCGAGCCATTGATTCGGCGATC | 3,178,587 | 51 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 7561. | GGTTCGACGATCGATGATCGAGCC[A,G]TTGATTCGGCGATCGACGATCGAGC | 3,178,598 | 51 |
| 7562. | ATCGATGATCGAGCCATTGATTCG[G,A]CGATCGACGATCGAGCCGTATTGGT | 3,178,607 | 51 |
| 7563. | CGAGGCCCTTTTGCCTTCAGAGGC[T,C]GAGGCCGTCGGTTCGGCAATCGGTG | 3,178,738 | 51 |
| 7564. | AGAGGCTGAGGCCGTCGGTTCGGC[A,G]ATCGGTGATCGAGCCATTGATTCGG | 3,178,756 | 51 |
| 7565. | GGTTCGGCAATCGGTGATCGAGCC[A,G]TTGATTCGGCGATCGACGATTTAGC | 3,178,772 | 51 |
| 7566. | CCGAGGCCGTCGGTTCGGCGATCG[A,G]TGATCAAGCCATTGATTCGACGATC | 3,178,854 | 51 |
| 7567. | CCGTCGGTTCGGCGATCGATGATC[A,G]AGCCATTGATTCGACGATCGACGAT | 3,178,860 | 51 |
| 7568. | GATTCGACGATCGACGATCGAGCC[A,G]TATTGGTCGAGGCCCTTTTGCCTTC | 3,178,892 | 51 |
| 7569. | TTCGACGATCGACGATCGAGCCAT[A,G]TTGGTCGAGGCCCTTTTGCCTTCAG | 3,178,894 | 51 |
| 7570. | CAGAGGCCGAGgCCGTCGGTTCGA[C,T]GATCGATGATCGAGCTGTTGATTCG | 3,178,941 | 51 |
| 7571. | ATCGATGATCGAGCTGTTGATTCG[G,A]CGATCGACGATTGAGCCATATTGGT | 3,178,967 | 51 |
| 7572. | CGAGCTGTTGATTCGGCGATCGAC[G,A]ATTGAGCCATATTGGTCGAGGCCCT | 3,178,976 | 51 |
| 7573. | TCGAGGCCCTTTTGCCTTCAGAGG[C,T]CGAGGCCGTCAGTTCGACGATCGGT | 3,179,016 | 51 |
| 7574. | TTGCCTTCAGAGGCCGAGGCCGTC[A,G]GTTCGACGATCGGTGATCGAGTCGT | 3,179,027 | 51 |
| 7575. | TCAGTTCGACGATCGGTGATCGAG[T,C]CGTTGATTCGGCGATCGACGATCGA | 3,179,049 | 51 |
| 7576. | ATCGGTGATCGAGTCGTTGATTCG[G,A]CGATCGACGATCGAGCCGTATTGGT | 3,179,060 | 51 |
| 7577. | TTCGGCGATCGACGATCGAGCCGT[A,G]TTGGTCGAGGCCCTTTTGCCTTCAG | 3,179,060 | 51 |
| 7578. | GATTCGGCGATCGACGATCGAGCC[G,A]TATTGGTCGAGGCCCTTTTGCCTTC | 3,179,078 | 51 |
| 7579. | TTCGGCGATCGACGATCGAGCCGT[A,G]TTGGTCGAGGCCCTTTTGCCTTCAG | 3,179,080 | 51 |
| 7580. | GCGATCGACGATCGAGCCGTATTG[G,A]TCGAGGCCCTTTTGCCTTACGAGGC | 3,179,084 | 51 |
| 7581. | GAGGCCGAGGCCGTTGGTGATTGA[G,A]CCATTGATTCGACGATCGACGATCG | 3,179,129 | 51 |
| 7582. | AGCCATATTGGTCGAGGCCCTTTT[A,G]CCTTCAGAGGCCGAGGCCGTCGGTT | 3,179,179 | 51 |
| 7583. | CAGAGGCCGAGGCCGTCGGTTCGA[T,C]GATCTGTGATCGAGCTGTTGATTCG | 3,179,208 | 51 |
| 7584. | GGCCAAGGCTGTCGTAGATACTCC[G,A]CTCCTTCGATCTCTATCAGGATCTG | 3,179,305 | 51 |
| 7585. | AGGAGTCATACCTGCGATGCATCG[G,A]TCTCGGACTCCGTCGTCGGGGCAAG | 3,179,381 | 51 |
| 7586. | CAGACGTCGGTTGGAAGCTCCTTC[G,A]TCTGCGCGCATGTATTTGTACGCGC | 3,179,516 | 51 |
| 7587. | GTCGGAGGTTCATGGAGGCTTCCG[A,G]CTGGTGCTGAAATGGGCCACGAAAG | 3,179,761 | 51 |
| 7588. | TAAACCGACTAGGGATCGGCTCAT[C,T]GAGGATGAGTCGGGAGAGAGGTTGG | 3,180,012 | 51 |
| 7589. | TTCTGTCCGRCCACCTGCAGCTGG[G,A]CAAGCTGATGGTTGATTTCTTCGAA | 3,180,092 | 51 |
| 7590. | GACCCCGGGGTGGAGRCTCCCGA[T,C]GAATCTGAGAGGGAGGCGGACGGTG | 3,180,178 | 51 |
| 7591. | GTTCCAGCTGGGAAGGAGATGGTC[G,A]TCGGGATCGGTGGGCATCATGTTGT | 3,180,255 | 51 |
| 7592. | TCGGGTGTGCCGTCGGTTGCTCCG[C,T]CGGTGAGTGTGGCAACTGGGTTGGT | 3,180,401 | 51 |
| 7593. | TTGCTCCGCCGGTGAGTGTGGCAA[C,T]TGGGTTGGTTGCTGTTGAAGGcTCT | 3,180,417 | 51 |
| 7594. | AGCACGGTCATCTGCCGCACGATC[G,A]TCGCGAACTGCACCTCCGTGGTCAC | 3,180,481 | 51 |
| 7595. | TGTGGCCAATCTCCTCGTCGCCTG[A,G]TCATCGGAAACGAGTGCCTGCAAAA | 3,180,717 | 51 |
| 7596. | AATCTCCTCGTCGCCTGATCATCG[G,A]AAACGAGTGCCTGCAAAAGAAGTCC | 3,180,724 | 51 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 7597. | TCCTCGTCGCCTGATCATCGGAAA[C,T]GAGTGCCTGCAAAAGAAGTCCGCAC | 3,180,728 | 51 |
| 7598. | GGAGAGAGAGAGGGTAAGCCCAAG[G,A]GTTTCGAAAGAACCTCTTCCAGCAC | 3,180,871 | 51 |
| 7599. | TCATCGGAGGCTGTCAGAGTCACC[A,G]TGGGGTTGTCAAATCACTGTGGGGC | 3,180,998 | 51 |
| 7600. | GACTGTCAAATCACTAGGGTTGAC[T,C]CATGTCTTGGGTGGGACGATGTCCC | 3,181,065 | 51 |
| 7601. | CATGTCTTGGGTGGGACGATGTCC[C,T]AGGGCTACGCCGCATGCCTTTGGGC | 3,181,090 | 51 |
| 7602. | TAATATGGGTTCGACCGCTCAGTC[A,G]GTCGGAAACAACATGGGTCGGTTCG | 3,181,304 | 51 |
| 7603. | AGTTGGACGTCCGTCGGAGTCGTC[C,T]GTCGGTCGTCGATCAGATCGGTCCG | 3,181,423 | 51 |
| 7604. | GTCGTCCGTCGGTCGTCGATCAGA[T,C]CGGTCCGAGAGTAAGTCGGCGTATG | 3,181,441 | 51 |
| 7605. | CGTCGGTCGTCGATCAGATCGGTC[C,T]GAGAGTAAGTCGGCGTATGGGGTC | 3,181,447 | 51 |
| 7606. | TCAGTCGGTATATCCCAATAACCT[C,T]TAAGATAATAGAAAAAGGTCTCGGC | 3,181,495 | 51 |
| 7607. | CGAAAAAGCCTCAGCTTGACTGAT[C,T]AGAGGAGTCATCCTAGGATTGACTG | 3,181,587 | 51 |
| 7608. | GAAAAAGCCTCAGCTTGACTGATC[A,G]GAGGAGTCATCCTAGGATTGACTGA | 3,181,588 | 51 |
| 7609. | ATTAGCGATGACAATTTTATCATC[G,A]ATAAAAAGAAGTCTTCGTATGACCA | 3,181,623 | 51 |
| 7610. | ATTAGCGATGACAATTTTATCATC[C,A]TAATAATATTTTTTATTGATAATAA | 3,181,715 | 51 |
| 7611. | AGTGATGGTATTTTTGATTTTTAA[T,C]GACAGCTAATTACGTCACTAATAAA | 3,181,801 | 51 |
| 7612. | GATGGTATTTTTGATTTTTAATGA[C,T]AGCTAATTACGTCACTAATAAAAAA | 3,181,804 | 51 |
| 7613. | TTTGATTCAAGAATTATTAGTGAC[G,A]GAGTTATCTTATTAGCAAtGGTATT | 3,181,871 | 51 |
| 7614. | GTGACAGAGTTATCTTATTAGCAA[T,C]GGTATTTTACCGTCACTAATAACCT | 3,181,890 | 51 |
| 7615. | ACGATTTTTATCTAATTGTGTGCC[C,T]CAATTTTCCCCACCCCCcTCTCATT | 3,181,983 | 51 |
| 7616. | CCGAGCATCCAAATCCTATTTTTC[T,C]CCATCGACGGCCGACTGACTGCTGG | 3,182,077 | 51 |
| 7617. | AAGCCCCGACTGCCTCCTCGAGCC[C,T]CCGTCCACCGAATCCAAGCCCCTCG | 3,182,140 | 51 |
| 7618. | CGTCGTCAGATCCGGCTTTCCCAA[G,A]CTGTCGGCCGCCTCCTCGAGCCCCG | 3,182,360 | 51 |
| 7619. | ATTTCCATCAACCTCATCGGTCGT[T,C]GCCTCACCACGCCACCTCACCACAC | 3,182,498 | 51 |
| 7620. | CAACATATATATCCCTGTATTGGT[G,A]TTTGCTTTCATGCCTATCTAATAAA | 3,183,117 | 51 |
| 7621. | AATTATCTTTATTTTTAAAATTG[G,A]TCGAACTGAGAGAAGAAACCAGGTT | 3,183,262 | 51 |
| 7622. | TTATCTTTATTTTTAAAATTGGT[C,T]GAACTGAGAGAAGAAACCAGGTTAA | 3,183,264 | 51 |
| 7623. | CTCTGTTCTTTTATGCAATTTGTC[G,A]GACACCTTAGATTCTATCTATTTAT | 3,184,744 | 51 |
| 7624. | CTAGCCATCGGAGCACTACGTTGT[C,T]AGACCCGCAATGTCAGACCCGCACC | 3,184,903 | 51 |
| 7625. | TGTCAGACCCGCAATGTCAGACCC[G,A]CACCACCTTGCACCGTGAGTATTAA | 3,184,924 | 51 |
| 7626. | TCACCATCGTCACACCCCATTTTC[A,T]TCTTTTTAAATTTTAAATATTTAAA | 3,185,009 | 51 |
| 7627. | CATCTTTTTAAATTTTAAATATTT[A,T]AAATTAGATTTATTTGATTATTTTA | 3,185,032 | 51 |
| 7628. | TTAAATTTTAAATATTTAAAATTA[G,A]ATTTATTTGATTATTTTAAATTAAT | 3,185,039 | 51 |
| 7629. | GGCTCTGACCCACTCATCTACTCT[G,A]ACGGCGATCGGAGTAACTCGGCAAT | 3,185,236 | 51 |
| 7630. | TGACCCACTCATCTACTCTGACGG[C,T]GATCGGAGTAACTCGGCAATTGAAT | 3,185,241 | 51 |
| 7631. | CACTCATCTACTCTGACGGCGATC[G,A]GAGTAACTCGGCAATTGAATTCTAG | 3,185,246 | 51 |
| 7632. | CACTCATCTACTCTGACGGCGATC[G,A]GACTCAAGGAGGCCAACATGATACC | 3,185,313 | 51 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 7633. | GTATCCCTACGCCACTTCTCCATT[G,A]TCGTCATCCACTTATCGGATTTCCT | 3,185,474 | 51 |
| 7634. | TCCTCCTCTATCGATAAGGTGAGG[C,T]AGCTTTGGAAGGTATGTTATTCCGT | 3,185,595 | 51 |
| 7635. | TTGATACTCTCAGATTCGAACAAT[A,G]TGGAGTCACCAGTAGCTCCACATTT | 3,185,992 | 51 |
| 7636. | AGCTCCACATTTACATGGAGCAGT[G,T]TCCAACTCTCAGAGCAGGTAAGTTT | 3,186,030 | 51 |
| 7637. | AGTAAAGGTTCAAGGTCAGACCAC[C,A]ATCGAACTGACTCTATCCCGATGGT | 3,186,422 | 51 |
| 7638. | TCATCGTGATGGGGACAGATCATT[G,A]CAATAATTGATCTTCAACGTGATAA | 3,186,568 | 51 |
| 7639. | TGGGGACAGATCATTGCAATAATT[G,A]ATCTTCAACGTGATAAACTCTAATA | 3,186,577 | 51 |
| 7640. | ATTTAATATAATATTCTTTATGAT[G,A]TCTTGATACTCTCAGGTTCAGACGA | 3,186,665 | 51 |
| 7641. | GTAAGTCTATTAATAATTTTTTtA[C,T]TTATTTTAAATATCTATATTTAGAA | 3,186,779 | 51 |
| 7642. | GCTTCACATATCTAGGCTTGAGTC[C,T]GAAAAAAGAATCTAGGGATAAAAAT | 3,186,829 | 51 |
| 7643. | GAAAAAAGAATCTAGGGATAAAAA[T,A]TTAATCTAACCATTCAATCGATGGG | 3,186,854 | 51 |
| 7644. | AATCTAACCATTCAATCGATGGGC[C,T]GGGAGTGTTTATATCTTCGTATCAT | 3,186,881 | 51 |
| 7645. | ATTCGAAAATTAGAGTAGTATATC[G,A]AAATATATACCTCTGTATCGATATA | 3,186,956 | 51 |
| 7646. | AAATTAGAGTAGTATATCGAAATA[T,C]ATACCTCTGTATCGATATATACACT | 3,186,962 | 51 |
| 7647. | TCATCCTTCAGCTACTAGAGAGGA[C,T]GTATAGAGGTAGGAGGAGGATGAGA | 3,187,055 | 51 |
| 7648. | CAGCTACTAGAGAGGACGTATAGA[G,A]GTAGGAGGAGGATGAGAAGGATGAT | 3,187,063 | 51 |
| 7649. | TTAATTTTATATTTATGATTATGT[T,C]AAATAATTATTATTTTATTTATAAA | 3,187,217 | 51 |
| 7650. | ACGGTAGTAGTAACGATAAAGGCC[G,A]TTGCTAATAATTTTTTGATATTTTA | 3,187,428 | 51 |
| 7651. | TAGCAGCGGCATTCCATCGCTAAT[G,A]CTATTAGTGACGATAAACTGACAAT | 3,187,608 | 51 |
| 7652. | ACGATAAACTGACAATTAGTGACG[A,G]CAATTAGCCGTCGCTAATTGTCAAT | 3,187,642 | 51 |
| 7653. | GAGGACTAAAGTTTGCCATATCAA[T,C]CCCCTTTCTCTATGAAATTTTGGCT | 3,187,981 | 51 |
| 7654. | TTTATCGCATTCTGATCATATAAC[G,A]GTCTACCTTTAAATGTCGTTATACC | 3,188,143 | 51 |
| 7655. | TATTATGGCATTATGGGCTTATAT[C,T]GACATGTCTCCAAGGGCATTATGAT | 3,188,275 | 51 |
| 7656. | CTCCCCAACACCATTCCTGGAAGG[G,C]CTGAAGCTACTGAGATTCTATAAAT | 3,188,799 | 51 |
| 7657. | ATATCTGCTTTCACTATTCTAACC[G,A]CATTCTTTGTTAGTCTATGCATTAT | 3,189,057 | 51 |
| 7658. | AGCGAAGTCCACAACAGCAAAACA[T,C]AGATGGAAAAGCCCATAGGTGTGCA | 3,189,580 | 51 |
| 7659. | AAAAGCCCATAGGTGTGCAAGCCT[G,A]CAAGCGTGGCTCATGGGCGCGCAAG | 3,189,611 | 51 |
| 7660. | GCCTGCAAGCGTGGCTCATGGGCG[C,T]GCAAGGCCCGCAAGCATGTGGCCCA | 3,189,631 | 51 |
| 7661. | AGCATGTGGCCCACAAGTGCACAG[G,A]CCCGCAGGCGTGCATGGCCAGTGCG | 3,189,668 | 51 |
| 7662. | CCACAAGTGCACAGGCCCGCAGGC[G,A]TGCATGGCCAGTGCGTGTGGCCCAA | 3,189,678 | 51 |
| 7663. | CCGTGGTTCACTGCACGGTTCATG[C,T]GCGGTCTATGGCACCATGCAGGAGG | 3,189,770 | 51 |
| 7664. | CGCGGTTCATGGAATGGATGTGCG[C,T]GATCCAAAGGTCGAGATGGTGTGCA | 3,189,905 | 51 |
| 7665. | CAGGGGTGATCCAATTGTGGCTGG[T,G]GTCTTGGACTCCCATTAGGACTTTG | 3,189,953 | 51 |
| 7666. | CGCTCGAAAAGAGAGGATTCATGG[C,T]CGAGAGCATCATAGGAAGCATCCAG | 3,190,110 | 51 |
| 7667. | ACTTCTCTAACAGCGATGAAAGTT[C,T]AAGGAGATGTACATGGTGAAGTCAC | 3,190,781 | 51 |
| 7668. | GTTCAAGGAGATGTACATGGTGAA[G,C]TCACTTACCAAAACTCTTTTTCTTT | 3,190,802 | 51 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 7669. | AGAGAAGAGCACCATCAGATGGAT[G,T]AAGTTACTTCTATATTTCTTCAGAA | 3,191,035 | 51 |
| 7670. | AGGTAGTGGCAGAGGATAAAGGGG[T,G]AAAAGATCGTAAGATGGATGGTCCA | 3,191,154 | 51 |
| 7671. | CAGAGGATAAAGGGGTAAAAGATC[G,A]TAAGATGGATGGTCCAGATCCAAAT | 3,191,163 | 51 |
| 7672. | GGATGGATCGAGCTGTGTGATCAA[G,A]gATATTAGAACTGTCAGCTTATAGA | 3,191,484 | 51 |
| 7673. | AGCTCGAATTTCATATTTGTCCAT[T,C]AATAAGTAGTCAGATATTTATCCTA | 3,191,938 | 51 |
| 7674. | ATTTCATATTTGTCCATTAATAAG[T,C]AGTCAGATATTTATCCTAGGGCATG | 3,191,945 | 51 |
| 7675. | AAGCTCTTAGAGTTAGATAGAGAC[C,T]GAATGTCGAATCGAGATGGAGATTG | 3,192,013 | 51 |
| 7676. | GATGGAGATTGTTAGATTTTGGCA[C,T]CTAAAATTTGACCCACAGTACCAAA | 3,192,052 | 51 |
| 7677. | CCCAGATGGAGGAGCTTGCAGGGG[C,T]GCAGGGTGCAGGCGCGGCCCATAGG | 3,192,103 | 51 |
| 7678. | TGCAGGCGCGGCCCATAGGCGTGC[A,G]AGGACCACAGACGCGTAGGCCCACA | 3,192,134 | 51 |
| 7679. | CGTAGGCCCACAAGCATCCAAGGC[T,C]AGCATGCATGGCCCGTAGTAGGCGG | 3,192,172 | 51 |
| 7680. | AGCACGCACGCATGGCCCAAAGGC[G,A]CGGGATGCATGGCCCAGACCACATT | 3,192,226 | 51 |
| 7681. | AACAAAAAAaTAACTCAACTCAAT[G,A]CTAAAGTTATGAATGTTTTATATTG | 3,194,626 | 51 |
| 7682. | CACTAATCAAGTTAAGAAACTGTC[C,T]TTTATTTGTTATGAATGTAAGAAGT | 3,194,763 | 51 |
| 7683. | CAAGAAGTACAAGAAAAAGACTAT[G,A]ATGGCTACATGAAGTGATAGTGATG | 3,194,856 | 51 |
| 7684. | AATGACTTTATTTTTGAAGAACTT[T,C]AAGAAGCATTTTATGATCTAGTTGA | 3,194,995 | 51 |
| 7685. | TTATTTTTGAAGAACTTTAAGAAG[C,T]ATTTTATGATCTAGTTGATGATTTA | 3,195,002 | 51 |
| 7686. | CTTTGTGAACTCATCAAGCAACAA[G,A]TTTTTAAATATTACTTACTTTAAAT | 3,195,318 | 51 |
| 7687. | TTTTAAATATTACTTACTTTAAAT[G,A]TAGTAAAGTAGGACACAAATCATAT | 3,195,344 | 51 |
| 7688. | AAATTCTAATGTGAAGAAAATATG[G,A]GTTCCAAAAGAAACTATTGTGACTA | 3,195,417 | 51 |
| 7689. | AGGCACATGACCGATGATGAATCT[T,C]AATTCATCACACATGATGCAAAAGA | 3,195,584 | 51 |
| 7690. | AGAAAAGATCATCGGTATAAGTAA[C,T]ATTGGTATGACTCCCTCTAAGTATA | 3,195,667 | 51 |
| 7691. | CATCGGTATAAGTAACATTGGTAT[G,C]ACTCCCTCTAAGTATATTAAAAATA | 3,195,676 | 51 |
| 7692. | TGAATGCCAAAATTAATGAGACTA[G,A]TTGGTTTTGGCACCGTAGGCTTGCA | 3,195,933 | 51 |
| 7693. | GTTGGTTTTGGCACCGTAGGCTTG[C,A]ACATATTAGTATGCATTCACTTTTA | 3,195,957 | 51 |
| 7694. | AGGCCATTAGAATTATTGTACATG[G,A]ATTTATTTGGACCCACTAGAACTAC | 3,196,139 | 51 |
| 7695. | TTGTCATTATTGATGATTTCTCTC[A,G]TTTTATATAAAGCTTTTTTGGCAT | 3,196,215 | 51 |
| 7696. | ATGATTTCTCTCATTTTATATAAG[C,T]TTTTTTTGGCATATAAGGATGAAA | 3,196,227 | 51 |
| 7697. | TTTATGTGTTCTCAAATTTTATC[G,A]AAAAGTTACTAATGAAAAAATTTT | 3,196,280 | 51 |
| 7698. | TCGAAAAGTTACTAATGAAAAAAA[T,A]TTTTAATTCAAAATATTCAAAGTG | 3,196,302 | 51 |
| 7699. | AAAGTGATCATGGAACCAAATTTA[A,C]AAATCAAGAATTTAAAAAATTTTGT | 3,196,346 | 51 |
| 7700. | TAAAAATTTATTGAACCAAATTTT[G,A]AACTCAATTCTCATCTCTTCTTTCT | 3,203,563 | 51 |
| 7701. | TTCTAGCCATGAATCGATCCTAAG[A,G]TAAACTTGTAATTTTCATTAAAATC | 3,203,715 | 51 |
| 7702. | ACACTCTTTTTTTtGAAAAATCTC[C,T]GTTAGTTAAGCAGGCTGACCCTTTG | 3,203,771 | 51 |
| 7703. | AAGTCTCTCTTCCCATCGGGTTTT[C,T]CCCTTCAATCGTCCTTTTAGAAACT | 3,203,897 | 51 |
| 7704. | GATCAAGCTTACCCTAGCTTCAAA[C,T]CCTCTTCTCCAAACCGATGGTCTAT | 3,203,980 | 51 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 7705. | AGCTTCAAACCCTCTTCTCCAAAC[C,T]GATGGTCTATCTCTCCAAAATCTTT | 3,203,995 | 51 |
| 7706. | TCTACCTCTCATTAGGTCTTCTAA[G,A]CTGTTTGCAAGTCTCTCTTGTCTGA | 3,204,070 | 51 |
| 7707. | TTGATCCATTACTTTTGGGATAAA[T,A]CTTGCACTTGCCTTGTGAATGTTAT | 3,204,885 | 51 |
| 7708. | ATATTATTTTAGGAAGAGCATTTA[C,T]TAAAAATTTAAATAAATTAgAAGCA | 3,204,972 | 51 |
| 7709. | TTTACTAAAAATTTAAATAAATTA[G,A]AAGCAAGGATACTTTCAGTAAAGAT | 3,204,992 | 51 |
| 7710. | TTAgAAGCAAGGATACTTTCAGTA[A,G]AGATGAGACTTTTGCATCACATGAT | 3,205,013 | 51 |
| 7711. | CCTTCCTACTCTGATGTTTGAGGC[T,C]ATGAGGGAGATCCTAAATAGGTCTA | 3,205,159 | 51 |
| 7712. | CAAAGACTGATGGCGGTTGGTCGA[A,C]GGGTGTTGAGGAGAGAGCAGAGGAG | 3,205,344 | 51 |
| 7713. | AGAGCATCTGCTGATATTCAGTTC[G,A]TGTTTGATCACGAGACTGGTCCCTC | 3,205,424 | 51 |
| 7714. | AGCATCTGCTGATATTCAGTTCGT[G,A]TTTGATCACGAGACTGGTCCCTCAG | 3,205,426 | 51 |
| 7715. | ATTAGCCTTAGCCCATCTCCAACC[G,A]TAAGAGAACATCATGGAGGTCTCCA | 3,205,777 | 51 |
| 7716. | GAACATCATGGAGGTCTCCAACCT[G,A]TCTACAGAGGCGGCTAGGCTTCGTG | 3,205,807 | 51 |
| 7717. | AGGTCTCCAACCTGTCTACAGAGG[C,T]GGCTAGGCTTCGTGGCATTTTGGAG | 3,205,818 | 51 |
| 7718. | TCTTCCCAGGCTCCAAGACCTTCT[T,C]GTCCTTCTGCTCGTGCCGGTACTTC | 3,206,009 | 51 |
| 7719. | GTGCCGGTACTTCTACCTGTGGCC[A,G]AGGCAGATGTGGTCGAGGATGTGCC | 3,206,046 | 51 |
| 7720. | CATGATATTTATTAGATCTAGCAT[T,A]GTTAATCTTTTATGTCTAGGATCTA | 3,206,159 | 51 |
| 7721. | TATTTATTAGATCTAGCATTGTTA[A,G]TCTTTTATGTCTAGGATCTAACTTA | 3,206,164 | 51 |
| 7722. | ATCCAATTCACCCCCTCTCCTCTT[A,G]GGTTGCATAGCTGGGTAACAGAGGT | 3,208,757 | 51 |
| 7723. | CTCCTCTTAGGTTGCATAGCTGGG[T,C]AACAGAGGTGGATGTGCGGTCCATG | 3,208,773 | 51 |
| 7724. | CGGGGGTGATCCAACAGTGGCTGG[T,G]GTCTTGGACTCCTATCAGGATAATG | 3,208,929 | 51 |
| 7725. | GTGTGGAAGAGAGGCATAGATAAC[A,G]GCTAAGAGTATCTGAGAGAAGAGGA | 3,209,041 | 51 |
| 7726. | GCTAAGAGTATCTGAGAGAAGAGG[A,T]TTCATCGTTGAGAGCATCATAGAAA | 3,209,066 | 51 |
| 7727. | AGAGGATTCATCGTTGAGAGCATC[A,C]TAGAAAGCATCCAGGGGCATCAGAG | 3,209,085 | 51 |
| 7728. | AAAGTTTTGTAAGAGCTTTTGTAA[A,G]GAGTTATGCTTTTATTGAGAGAAA | 3,209,173 | 51 |
| 7729. | ATGCCCCATGGAGATAAGCCTTGG[A,G]CTAATCCACGTATTTGATCATGTTC | 3209290 | 51 |
| 7730. | TTATCACATAATCTGTCGGTTGCT[C,T]TATATAGACCTCCTCATCAATATAG | 3,210,661 | 51 |
| 7731. | ATCTCTTCATCTATGGCATACTTC[T,C]ATATTTTACTTTTTATAGCATCTTC | 3,211,001 | 51 |
| 7732. | AAAGATGAGCTTTGAGCTTTTATC[C,A]TCTAGCTTGACTCTCCTCTGCTTCA | 3,211,408 | 51 |
| 7733. | CAAAATATGTGCAAAGCTATACAT[C,T]TGAAGATCTTCATGTGTGAGATATT | 3,211,456 | 51 |
| 7734. | CCCACAAAATACTTCAAATGAATT[G,A]AAGGTGAACTCGCCGCCTCGATCTA | 3,211,740 | 51 |
| 7735. | TTCAAATGAATTGAAGGTGAACTC[G,A]CCGCCTCGATCTAAGCGAATGACTT | 3,211,752 | 51 |
| 7736. | GCCTCAAGTGCCACAATCATGAGG[C,T]ATCTTTTACATAGAGTTTCAAGCAC | 3,212,156 | 51 |
| 7737. | GATACAGCAGGAAGAAAGAAGAAA[C,T]AAAATAGAAAATAATCAAAATACGT | 3,212,422 | 51 |
| 7738. | AAAGGACTCGCCTCCACGGGGCAT[G,A]CAAACTTTACTACGaAAAAAAATT | 3,212,484 | 51 |
| 7739. | ATAAAGTTTTTTCTCACAAAAGCT[C,T]TCTCTCTTAAAAGACCCCCTGAATC | 3,212,584 | 51 |
| 7740. | CTCTCTTAAAAGACCCCCTGAATC[C,T]CTAAAGCGACCATTGTTCGCTGTCC | 3,212,610 | 51 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 7741. | AAAAGACCCCCTGAATCCCTAAAG[C,T]GACCATTGTTCGCTGTCCAGAAGCC | 3,212,617 | 51 |
| 7742. | CGTCATACAGAAAACTCAAGTCAC[G,A]GATTCTGTTTTCATGAGAAACCAAG | 3,212,729 | 51 |
| 7743. | TCATGATCGATCCACAAAATAGTA[T,C]CGTGGACCGCACAAAATGCATGGGA | 3,212,927 | 51 |
| 7744. | TAGTATCGTGGACCGCACAAAATG[C,T]ATGGGAAATGCCCATGCAGTCCACA | 3,212,946 | 51 |
| 7745. | AAATGCCCATGCAGTCCACAGACC[C,T]GACCGTGGACTGTCCAGTCCACTGT | 3,212,976 | 51 |
| 7746. | CATGCAGTCCACAGACCCGACCGT[G,A]GACTGTCCAGTCCACTGTGGATCGG | 3,212,983 | 51 |
| 7747. | GTGCGCCTGGCCCATGTGCTGCCA[C,T]GCACTGGGCGGCATCCCACCGCCTA | 3,213,133 | 51 |
| 7748. | CACTGGGCGGCATCCCACCGCCTA[T,C]GGTCGCACCGCTATCACTCCGTCGG | 3,213,159 | 51 |
| 7749. | TGGACTCAATATGGATCAAATCTC[G,A]AGATATCAAATTCTAACAATCTCTA | 3,213,346 | 51 |
| 7750. | TGACCTGAGACCTACTCAAGGTAT[C,T]GTCCTACGGTAATAGGAATCCCACC | 3,213,551 | 51 |
| 7751. | ATTCTCCCGAGTCTCCTGTCTCGT[A,G]TCCGATCCAGCTCCACTTACAGCTC | 3,213,618 | 51 |
| 7752. | CTCCTTCTTCCCCTCCAGCATAAT[C,T]CTATCACCACGTAGCACCTTCAGAA | 3,213,749 | 51 |
| 7753. | GTAGCACCTTCAGAATTTCTCCAT[C,T]AGCTACTGTCCTGTAGCCTCTCGAA | 3,213,784 | 51 |
| 7754. | GAAATTGGATATGTATCGGATCTC[T,C]CCTAATCTTCTCACTATACCATCAT | 3,213,866 | 51 |
| 7755. | CTGAATCGCTACCGGCCGTCGCTA[C,T]AGCAGCCACCATCCAATTTTTGAGT | 3,214,087 | 51 |
| 7756. | CCGGCCGTCGCTACAGCAGCCACC[A,G]TCCAATTTTTGAGTTGAGAGCAATC | 3,214,098 | 51 |
| 7757. | GGCCGTCGCTACAGCAGCCACCAT[C,T]CAATTTTTGAGTTGAGAGCAATCTT | 3,214,100 | 51 |
| 7758. | CCGTCCTCATCGCGATCTCCTGTC[G,A]CTCCGTCTACCACCTTCTGCTCCTC | 3,214,217 | 51 |
| 7759. | CCTCATCGCGATCTCCTGTCGCTC[C,T]GTCTACCACCTTCTGCTCCTCCAAA | 3,214,221 | 51 |
| 7760. | TCTTCTCTACTAGAAGAGCAGTCA[T,C]CAAGGACTCGTATGAAGATGGAAGT | 3,214,378 | 51 |
| 7761. | TACTCCTGCATGCTCTGTCCCTCG[A,G]CCATCCGTAGCTGATAAAACTGCCT | 3,214,518 | 51 |
| 7762. | TAGCTGATAAAACTGCCTCCAGAG[G,A]AAAAGAGTGCTGGTGAGAGACTTCA | 3,214,550 | 51 |
| 7763. | AGTGCTGGTGAGAGACTTCACCAT[G,A]TACAACTCCTCGAGCTTTGATCAAG | 3,214,580 | 51 |
| 7764. | GAGCTTTGATCAAGCACCATCGGG[G,A]AAGTCTCGCTCAGCACATGAATCAC | 3,214,616 | 51 |
| 7765. | AATCACCACCTCATCCGTTAGGTA[T,C]ATGCGGATGGTACTCACCGCCTGCA | 3,214,660 | 51 |
| 7766. | GTATATGCGGATGGTACTCACCGC[C,T]TGCATCTGTAGCCATTTCCAATCCC | 3,214,681 | 51 |
| 7767. | TCTATCTTCAGTCTTGCTCACCAC[C,T]GCTGCAATCTGCATCCTTGTACCAC | 3,214,880 | 51 |
| 7768. | CCGCACGCCCCACGCCAGGCTGTG[A,C]CCTGCGTGCTTGGCCCGTGCACTGC | 3,215,734 | 51 |
| 7769. | TTTAAAAGTACGTATCTTCTCTTT[T,C]CGAGCTCCGTTTGGGGTGTTCTTGA | 3,215,837 | 51 |
| 7770. | ACGTATCTTCTCTTTTCGAGCTCC[G,A]TTTGGGGTGTTCTTGATCTTGTTGG | 3,215,846 | 51 |
| 7771. | AAGATGCTCTCAGATTCCTTCATC[C,T]GTAAGGCTTCAAATTCTCCTTGTAG | 3,216,776 | 51 |
| 7772. | AGATGCTCTCAGATTCCTTCATCC[G,A]TAAGGCTTCAAATTCTCCTTGTAGC | 3,216,777 | 51 |
| 7773. | ATTAACGCTTTTGTAGGCCAGAAT[C,T]TCCCACACTTTCTTGGAAGTTGTTG | 3,216,853 | 51 |
| 7774. | TCCAGAACTATCCAACTAAAATTT[C,T]TAATTCAAAATTAAGTTTATCTTTT | 3,217,241 | 51 |
| 7775. | GTCTGAAACTTATTTTGTTTGGGT[T,A]TTTTTtAGATCAGCTTGGATATACC | 3,217,630 | 51 |
| 7776. | AACTTATTTTGTTTTTTTTTTTTT[T,A]AGATCAGCTTGGATATACCTAATAT | 3,217,636 | 51 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 7777. | GAAATAGTTAAAAAAATGAATGCA[G,A]TAAGTCGGATGGATTTGGCAAGGTC | 3,217,995 | 51 |
| 7778. | CACGTTGGTATCCGACGCGTTCCC[A,G]TCCAAATCCAACACGAAGACGTAGT | 3,219,200 | 51 |
| 7779. | GGCCGCCGTGATCGCCGGCGTCGG[C,A]GGCAGGTGGAGGCGGGTGGCCTCCT | 3,220,018 | 51 |
| 7780. | TTCTCTTTTGGAATTTACGGCTGG[T,G]GAAATCAGATCAGCTAGTTTATAGG | 3,220,881 | 51 |
| 7781. | ATGAGATAATCTGGATTGCTAAGG[G,A]AAGGGATGGCTATCCAGATTACCAC | 3,221,482 | 51 |
| 7782. | AGATAATCTGGATTGCTAAGGGAA[G,A]GGATGGCTATCCAGATTACCACCAC | 3,221,485 | 51 |
| 7783. | TGTGTTCGCGCATGGCCCCCGACC[G,A]CCACCACAGGTGGAGGAACTCCCGA | 3,221,793 | 51 |
| 7784. | AATAAGTATTATAAAATAGTATAA[A,T]TTTTTTtCATATAATAATTTTTATC | 3,222,309 | 51 |
| 7785. | ATATTACCAATAATCTGATTGTCA[T,G]ACCAAATATGTCAATCAAGATTCTC | 3,222,434 | 51 |
| 7786. | TAGATTATTGGGATAGAAAATTTT[T,C]CTACTAACCTACAAATCAAAATTGT | 3,222,644 | 51 |
| 7787. | TCGACATAGAGCTGAGGCTCCATA[C,T]TGATGGCTATATTTGATGTCATCTC | 3,222,745 | 51 |
| 7788. | CATTTTCTATCTTCGGTGAGATCT[A,G]ACCATAGGATTGGTAATGTTCCGAC | 3,222,818 | 51 |
| 7789. | CAAAGAGTCGGTCCGTCTTGTTTT[C,T]TTGACTCTCTCCGATGTTCGAGGTA | 3,222,915 | 51 |
| 7790. | CCGACAGGCCAAGTGGAGAGATCC[A,G]ACAATTTGGTAGTTGAATTTATACT | 3,223,439 | 51 |
| 7791. | GCAATGAGTTTTGGAGTGAAAATC[C,T]CTATGGCAACCACAATCGTAGGCCA | 3,223,788 | 51 |
| 7792. | GGCTGGCTCCTCATCCAGGGACTA[G,A]ATCTCCACATCCCATAGTGCAGGTA | 3,223,885 | 51 |
| 7793. | TCCTGTGTGCGAGTTCAAAGATTT[C,T]TGCGATTCAGGTAACGAGGAGTCAA | 3,223,936 | 51 |
| 7794. | TGACGTTCTCCTTTATTTAAGAAA[A,T]TTTTTTTGATTACTACTAAACTAAC | 3,224,603 | 51 |
| 7795. | AGGATAGAAATGGCAGTCAAACGG[A,G]TTTTTCCGAGTATCTAACCCATTCC | 3,224,762 | 51 |
| 7796. | TCCATTTGGGTTTGGAATGGGTTT[A,G]GGATTTAACCCTTGGGTACCCACCA | 3,224,881 | 51 |
| 7797. | TTAGGATTTAACCCTTGGGTACCC[A,G]CCATCCAAACTCGTTTATATATAAA | 3,224,903 | 51 |
| 7798. | TGGGGGGAAGGAGAGATCCAAAGG[A,G]AGGTTGGAGGGGTTTTTAGATTCCA | 3,225,995 | 51 |
| 7799. | GGATTTTTATTTAATTTTGTAATC[G,A]GGTTTGAGATGGATTCAGGTAGAAA | 3,226,272 | 51 |
| 7800. | TAAACAGCTTCGAAAATGGGTAGG[G,A]CAAATTTTGTAGGTATCCTATCCAT | 3,226,327 | 51 |
| 7801. | CTCCAGCCTCAGCACCATCTTCAA[G,T]GATGTCAAGTACTGACCCAATGGAA | 3,226,417 | 51 |
| 7802. | AATAGAGTGCAGAGAGATTATTCT[G,A]CTCTTTAAAATCATCAGCTTGCTTG | 3,226,677 | 51 |
| 7803. | AGAGATTATTCTACTCTTTAAAAT[C,T]ATCAGCTTGCTTGGGAGTAGATGAG | 6,226,689 | 51 |
| 7804. | GCCAAGTCCAAGCTGTTGGTTGCC[T,C]AGGAGAAATTTGAAGCTTTAGAGGA | 3,227,042 | 51 |
| 7805. | CCTAGTGAGGCACTACAGCAAAAG[G,A]TGGCCGAGCTTGAAGGAGCATTGGA | 3,227,092 | 51 |
| 7806. | CGAGCCGACCATTGAAGGCATCGC[T,C]ATCGGTCCTGCTACCGAGCCCATTC | 3,227,467 | 51 |
| 7807. | GCAAGATTGTTACTTCGATCAAC[C,G]TCTTGAGTTGGTTAGAGTATAGAAA | 3,227,655 | 51 |
| 7808. | TGATTTGAAATCAAAATTTTCATT[G,A]TCAATTTGTGACGATCTTGCCAAGT | 3,227,753 | 51 |
| 7809. | AGCCTTTGCTCGATTCATTCATGG[A,C]TAAGGAGCACCAGATGCCATATGGG | 3,227,905 | 51 |
| 7810. | ATATGGGATCTCTAGAGGATTAGT[C,T]CCTTTATAATCATCATCGACCTTCG | 3,227,948 | 51 |
| 7811. | CCTTCATAGTTGTCATCAGCCTCC[A,G]CTCAACTCATCCATAGACAAAGAGT | 3,228,058 | 51 |
| 7812. | ATCTGTGGATAAGGAGTGCTAAAT[G,A]GCCATACGAGGTCTCTGGAGGATTA | 3,228,262 | 51 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 7813. | TGACCCATCTATGAACAAAGAGCG[C,T]CAGATAGCTATATGGGTCCCTAGA | 3,228,342 | 51 |
| 7814. | CCAAGCATTATAATAGTGGTCTAC[T,C]CATTATTGATATGATGCCATTTTGA | 3,228,769 | 51 |
| 7815. | TGATATGATGCCATTTTGATCTGA[G,T]CTTGCTTCCTAGTTTTTTCGAACAA | 3,228,800 | 51 |
| 7816. | ACAAGTTCAAGTTCATTTGAAGTC[A,G]GCCCGAATTCTCTTACTCATCATAG | 3,228,846 | 51 |
| 7817. | GATAAGCCCATAATACCTTATAAA[A,G]TTTTTCGATCTAGAGCCCTTTGGCT | 3,228,992 | 51 |
| 7818. | AATGGATTCTAAATAAAATCCTAG[A,G]CCTTCTTCTTGATAATTTAAGCCAA | 3,229,223 | 51 |
| 7819. | TATTTATTTGGTGAAATAGTCGAC[T,A]GCAATGATCAAAAACTTTCTCTAAC | 3,229,285 | 51 |
| 7820. | CTCTAACCAGTGGTCATCAGGAAC[G,A]GCCTGAGGATGTCAATTTCTCACAT | 3,229,328 | 51 |
| 7821. | GACAATAATTAGTGCAAGCTCCAT[A,T]GCTGGCCTCTGCTAGCTATTGGCAT | 3,229,393 | 51 |
| 7822. | GCTATTGGCATAATTCTGGCACTG[C,T]CGTCGGTTGTATCCTATTGTAGAGT | 3,229,432 | 51 |
| 7823. | TAGAGGTAGTGAATATGATTTTTT[A,G]TAAAGTCTCTCTTCTAAGTAAACAC | 3,229,608 | 51 |
| 7824. | GGTGCTTGATCCTCTGAGTTTCAA[C,T]AGGACTGGTTAGTAAGGCACCGTTA | 3,229,670 | 51 |
| 7825. | AACAGGACTGGTTAGTAAGGCACC[G,A]TTAAGAAGGTAGTTGATTAGAGGGT | 3,229,692 | 51 |
| 7826. | TTCTCTGACCTTGGTATATGTTGT[A,T]CCTTCTAATTTTAGAAGGCCTCTAA | 3,229,885 | 51 |
| 7827. | TCCTCGAGCCTCATATTCTTCTCA[A,G]ATTTATTCGATGATGAGTTGCAAGT | 3,229,974 | 51 |
| 7828. | GGCAGTAAAGTCGAATCAAAGTGT[C,A]TATTCCATCACGTCCCCTATCGGGC | 3,230,110 | 51 |
| 7829. | GAATCAAAGTGTCTATTCCATCAC[G,A]TCCCCTATCGGGCTTGCAAGGATGA | 3,230,122 | 51 |
| 7830. | GCTTGGAGAGCAATGAGGATGATC[T,A]GAGATATCGTTTGAGCTCTTCAAAT | 3,230,658 | 51 |
| 7831. | GAAACTCTTCATTTGCCTGAGGAT[A,G]TTGAAGAATGGAAGGTACTTTTTTC | 3,230,734 | 51 |
| 7832. | CTGAGGATATTGAAGAATGGAAGG[T,C]ACTTTTTTCGACCGACCTCAAAATG | 3,230,750 | 51 |
| 7833. | ATCCCCATCAGATTACCATAAATC[C,T]TAAAAATTTtTTTGATGTCACACCA | 3,230,906 | 51 |
| 7834. | CATTTAGTTTCACCTCAACCCAAC[C,A]AATGCTTCCTCCAAATCGATGATAT | 3,230,982 | 51 |
| 7835. | GCATCATTTGTTAGCAATACAAAA[T,C]TTAATCGGTTATGAATGCCATCTTC | 3,231,161 | 51 |
| 7836. | TTTGGAGGCCATTTGAATCTGATT[G,A]TAGTCGGAGAAAGCATTCATGAAGC | 3,231,219 | 51 |
| 7837. | AGAGGAAGAAAAAAGAGAGACAAT[C,T]AAATAACGTGGATTGACTCAAGACT | 3,231,360 | 51 |
| 7838. | TTGACTCAAGACTTATCTCCATGG[G,T]GTATACAAACTTCACTATAAAAAAA | 3,231,397 | 51 |
| 7839. | CTCTCATAAAACTCTCAACTCTCA[C,T]AGGAAGATCCTCTCAGCTACTATCT | 3,231,522 | 51 |
| 7840. | AAGATCCTCTCAGCTACTATCTCT[A,T]AGACTCTCTGCCGCCACACATGATA | 3,231,550 | 51 |
| 7841. | TAGGATTCTAAGTCTAAACCGTGT[C,T]TAGAACCACCTATAGACCGCAGTAG | 3,231,665 | 51 |
| 7842. | CAGTAGACCACCATAGACCCCTCC[A,T]CATGAATCGAAGCCATGGACCAGCT | 3,231,709 | 51 |
| 7843. | GCCACATGTGCCACGCTCACCCTC[G,A]CTCGTGTGCATCGTGACAAAGACCA | 3,231,770 | 51 |
| 7844. | CGCTCACCCTCGCTCGTGTGCATC[G,A]TGACAAAGACCATGCATCGTGCGGT | 3,231,783 | 51 |
| 7845. | GCAACTCCCGCACTCTTGGACAGC[A,G]TGGTGGTCCGTGCATCTCGTGCAGC | 3,231,869 | 51 |
| 7846. | CCGTGCATCTCGTGCAGCCTGGGC[T,C]GTGCCTGTGGGCCTGCGTACCTAGT | 3,231,901 | 51 |
| 7847. | GAGGCATCAAAATCTAATAATCTC[C,T]ATCTTGACTCGACATTCGGCCTCCA | 3,232,050 | 51 |
| 7848. | TTCATATACTATGACCTGCTTGAC[C,T]TGAGATCTGCTCGAGGTAGCATCCT | 3,232,212 | 51 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 7849. | TCTCCATCTCTAGCTGCTTGAATC[T,C]AGTCTGCTTAGTGAAATCAGATTAC | 3,232,488 | 51 |
| 7850. | AACTTGCTCACTGCTCCATCATAT[A,G]TCTACAAGCTAACTGTTCCAATATC | 3,232,570 | 51 |
| 7851. | AAACATGCTGAATCTAAAATCTAC[T,A]AAGAAAAAGAAGTAGATATCTTATC | 3,232,713 | 51 |
| 7852. | CTGCCACCACCACCTTTAGTCACT[T,G]CCAAAGTCGAGTTGCTATCTGAATT | 3,232,962 | 51 |
| 7853. | GTCGAGTTGCTATCTGAATTTGAA[G,A]CTCGATTCTCTCATTTGAAGATCTT | 3,232,992 | 51 |
| 7854. | AAGTCTCAATAAGCACATGGATCA[T,C]CATATTATTTATCAAGAATAAGTAG | 3,233,350 | 51 |
| 7855. | ACCACCTGCATCTAGAGCTGCTTC[A,G]AACTTTTATCCTCCATGATAGTCGA | 3,233,409 | 51 |
| 7856. | AAACTTTTATCCTCCATGATAGTC[G,A]ATTTTCTTCGCACAAGAGAGTATC | 3,233,433 | 51 |
| 7857. | CTCTCGCTTGCTATAGGAAGAAAT[G,A]ACTCTTCCCATCATACCGATTGATC | 3,233,515 | 51 |
| 7858. | TCCTATCAGGATTCTAAGTCCAAA[C,T]TGTGTCCAGAGCCGCCTATAGACCA | 3,234,035 | 51 |
| 7859. | CAAGCCCCCACTCACGTGCCCTGC[G,A]ACAAAGACCATGCATCACCCGATGG | 3,234,149 | 51 |
| 7860. | TGCGACAAAGACCATGCATCACCC[G,A]ATGGACCGCATGAAGACCGCACGTG | 3,234,170 | 51 |
| 7861. | CATGCGGCGGTCCATGCATCTCGT[A,G]CATCTTAGGCCATGCCTATGGGCCG | 3,234,264 | 51 |
| 7862. | CTATGGGCCGCGCTTGCAGGCCTA[C,A]GTGCCTGCGGGTCATGCTCCTGTGG | 3,234,321 | 51 |
| 7863. | AGTTTTACTGCTGTAGATCGAATT[T,C]GAGATACCAAAACCCAATATTGATA | 3,234,413 | 51 |
| 7864. | TAAATCCCATTGTCAGGAGTTTGT[T,C]AACTTTCTCCTCAATTACTTATTGT | 3,234,618 | 51 |
| 7865. | TCCTCAATTACTTATTGTCATTCT[G,A]GGGTGAAGCTTCTTTTCTTTATCA | 3,234,650 | 51 |
| 7866. | TTCAACTTATGAACAATGATATCG[A,G]AAGGTACATCTGGCATGTCTGATGC | 3,234,725 | 51 |
| 7867. | TAAGGTTCGGTGTCAATTATGCTC[C,T]AAGCTAAATGGTTCTGCTCGAATCA | 3,234,828 | 51 |
| 7868. | TTTATTATCACCAAAAAGGATTGA[C,A]AAGCCAGTATTTGATCTTCTCATAC | 3,234,980 | 51 |
| 7869. | TTATTATCACCAAAAAGGATTGAC[A,G]AGCCAGTATTTGATCTTCTCATACT | 3,234,981 | 51 |
| 7870. | TCGATCAATAGACAGTTTCATTCT[T,A]TGAAAACTATTGTAAAACAACACAT | 3,235,278 | 51 |
| 7871. | GAGGATTTCTTTTCTGCTCAAGTC[G,A]TTCAAGGATCCTCCTAACCTCACTT | 3,235,895 | 51 |
| 7872. | GGTCAGCATAATTTTTTGAAAAAA[A,T]TTTATCGAGGGAGAAGATGTGGTAC | 3,236,031 | 51 |
| 7873. | CTCAAGCTTCGACGTGAGGATAAT[C,T]GAGGTGTAAAAGTGGGAGCAGAGTA | 3,236,698 | 51 |
| 7874. | TTATTGCTCTGCCACCTATTGAGG[C,T]CATTGTACGGCATAGTTAGAGTTTG | 3,236,841 | 51 |
| 7875. | GAACCAGGGCATCCAATGGTAGTG[T,G]ATTCTGTTGGGAATAGTGTTTCAAA | 3,236,899 | 51 |
| 7876. | CATCCAATGGTAGTGTATTCTGTT[G,A]GGAATAGTGTTTCAAAGCCAATCGT | 3,236,908 | 51 |
| 7877. | TTATAAATTAATAAAAATTATTTT[A,G]GTATTTTTCATCATAAAATATTTCA | 3,237,002 | 51 |
| 7878. | GATGACAATATTTATCAAGCATAG[G,A]TCATTGTGTACCATATAGGTTGGTT | 3,237,170 | 51 |
| 7879. | TTTATCAAGCATAGGTCATTGTGT[A,G]CCATATAGGTTGGTTGTCCTCTTAA | 3,237,180 | 51 |
| 7880. | TAACCAATGAGTGTGGAGACACTG[A,G]TATGGCATACAGGTGAGATGTAAGG | 3,237,227 | 51 |
| 7881. | GAGATGTAAGGGTACATCTGCACT[A,G]AACGTGACCGACTCCAGAGCTATTT | 3,237,266 | 51 |
| 7882. | GGGTACATCTGCACTAAACGTGAC[C,T]GACTCCAGAGCTATTTCTGCTGTCA | 3,237,275 | 51 |
| 7883. | CTCCAGAGCTATTTCTGCTGTCAA[A,G]ATTTGCTCTGATGGAATATGGGTAT | 3,237,302 | 51 |
| 7884. | GTGTCAAGATGGGATTGACCACTC[T,C]AGTTTAAGAGCTGTGTACAGTCATA | 3,237,487 | 51 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 7885. | GATGGGATTGACCACTCTAGTTTA[A,G]GAGCTGTGTACAGTCATATTTTAAT | 3,237,494 | 51 |
| 7886. | TGTGTACAGTCATATTTTAATTTA[G,T]CAAAACCTTGGTCAGGATAGTCTTT | 3,237,523 | 51 |
| 7887. | AGTCATATTTTAATTTAGCAAAAC[C,T]TTGGTCAGGATAGTCTTTGCGAGGA | 3,237,530 | 51 |
| 7888. | AAACCTTGGTCAGGATAGTCTTTG[C,T]GAGGAGTCACAGGACTGTTTGAGTT | 3,237,550 | 51 |
| 7889. | TCACAGGACTGTTTGAGTTGATCA[T,C]GATTCGGATGATCTAATCAGGGTTG | 3,237,581 | 51 |
| 7890. | GGACGATCAGCAGAGGTCAGACAT[G,A]CTGTGTAGCTATATTATGATGATCA | 3,269,074 | 51 |
| 7891. | TATATTATGATGATCAGACTCTCC[T,C]GACGGTGATCAGATTGCGGCGATCT | 3,269,108 | 51 |
| 7892. | CTCCTGACGGTGATCAGATTGCGG[C,T]GATCTACTACCCGCACAAAGGTATT | 3,269,128 | 51 |
| 7893. | GTATTGTGTTCTGAACACATTACA[A,G]TAAAGTGTTTACTGTTCAAATTCGA | 3,269,173 | 51 |
| 7894. | GCATGCTATATATCATATTTAGAT[T,C]CTAATGTAGGATAAATTTTTATTAA | 3,269,242 | 51 |
| 7895. | TTAGATTCTAATGTAGGATAAATT[T,C]TTATTAATTAATTAGATTAATTAAT | 3,269,260 | 51 |
| 7896. | TTAATTAGATTAATTAATAATTTT[C,T]ACTGTAAAATAGTGATTTTGAAAAA | 3,269,292 | 51 |
| 7897. | ATTACCATTTTACCCCTGCACTGA[T,A]TTTCCCCACAAATTCATCGTAATAG | 3,269,350 | 51 |
| 7898. | TGAGAGATGGTGGAATTATGTACT[C,A]TCGTCTGTACCATGCTCTCTTTCCT | 3,269,461 | 51 |
| 7899. | TGCGGTTGAGGTTGGTGCCAATTT[G,T]AGGCCGACACATCCAAAGAGAACCT | 3,269,581 | 51 |
| 7900. | GATTGTTAAGGTAGAAAATCTTTC[T,A]ACTAATCTGCAAATCAAAATTGTTA | 3,269,866 | 51 |
| 7901. | ATCTTGATTTTTCAGCTCTCTTCA[G,A]GGTTCGAGATAGTCCTGCTGAGCCA | 3,270,146 | 51 |
| 7902. | AGAAAAGAAAGGTTGCTTCATACG[G,A]TAGATTGCCTCCGTAACAAGTAGGC | 3,270,224 | 51 |
| 7903. | ATTTATTTTTATTTTtATTTTtTT[G,A]TGCGTTAGAAATCATTGCATTAGTG | 3,270,373 | 51 |
| 7904. | GATCCTAGATCCAAACAGAATCCC[G,A]AATAGCTTCTATCCAAAAACTGAGT | 3,270,950 | 51 |
| 7905. | GAGTCGGCTCATCTGAAACTGAGT[G,T]AGTTCAAACTAAAACTGAGTCGACT | 3,271,017 | 51 |
| 7906. | ACCTTGATGCTCCTAAGCCCTTGT[G,A]AACTCAACTTTATTCTTCAGACCTA | 3,271,319 | 51 |
| 7907. | AAGCCTCTTCAACCACAATGCTTC[T,C]TTAGAAGCATCTGTGATACCTATGT | 3,271,616 | 51 |
| 7908. | AGGTCCATCTTGCTATCCAAAAAT[T,C]AGACCAAACCTTCGAGTTTCCTGAA | 3,271,853 | 51 |
| 7909. | AACCTTCGAGTTTCCTGAAGATAC[C,A]GCAAAATTCACTTCAATGCCTGCCG | 3,271,884 | 51 |
| 7910. | CTGCTGCTTTGAAAGAGACATATA[G,A]CTTGTCAATGGTGTTCCAACCAGTT | 3,272,901 | 51 |
| 7911. | TAGCTTGTCAATGGTGTTCCAACC[A,G]GTTTGGCCTTCTTCATCCCAAACCT | 3,272,113 | 51 |
| 7912. | ACTGCATCTGCACTTCTTTTGGCA[T,A]TGAGCATATCGTCCACATGCAGAAG | 3,272,311 | 51 |
| 7913. | GGCATTGAGCATATCGTCCACATG[C,T]AGAAGCAAGTATAATGCATCATCTT | 3,272,331 | 51 |
| 7914. | GCTCCAACTCCATATCATGCTAAG[C,A]TACAAGCGACAGCAACATCCGGATT | 3,272,618 | 51 |
| 7915. | ATCTAACTCCATCTTACTCTGAAG[G,A]TGCCTCCTTCCATGTGAACACCCAC | 3,272,756 | 51 |
| 7916. | TCCAGTGACTCCATCTCTTCTCTC[A,G]TGGCCTGTATCCATGACTCCCGATC | 3,272,866 | 51 |
| 7917. | CCATACCTAAGCGATCTGTAAATT[A,G]TACGTTGGAGCTTGTGCAATGCCAC | 3,272,995 | 51 |
| 7918. | AATCCTACAATAGATACCCTTTGA[A,C]TCTCTATGGATACCTGATGAATGTC | 3,273,332 | 51 |
| 7919. | GAATGTCATCTTCTGAGACTTTGG[G,A]TCCAACTTGCTTCTTTTCAGTTGCC | 3,273,375 | 51 |
| 7920. | TCACTGTGTAATGATGTTTGATAC[T,C]ATTCTCCTCACAGTACCTTTTGAAC | 3,273,678 | 51 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 7921. | TTTTGAACTCTAGACTTGTGTATT[C,T]TCCTCCATTATCAGACCTCAAGCAT | 3,273,720 | 51 |
| 7922. | ATACATCAGCTGCTCCTCCTGTAC[C,T]GCTACAAGCACTTCCCTACTATCAT | 3,274,138 | 51 |
| 7923. | GCTCCTCCTGTACCGCTACAAGCA[C,T]TTCCCTACTATCATTCACCACTGAG | 3,274,149 | 51 |
| 7924. | ACATAATATCACACTCTGTGGATC[C,T]ATCTGATACAACCAGCAGATCTTCC | 3,274,545 | 51 |
| 7925. | CTACTCCCAGATGCCGTATCATCA[T,C]TTTTGCTGGCCTTTCCCTTCTTTGA | 3,274,598 | 51 |
| 7926. | AGAATTTTCTTTGCAAATCTTTTT[C,T]CGTTGCTTATTAGACTTGAGCACTC | 3,274,809 | 51 |
| 7927. | GATCTTTTGCTGAACCACCAAATT[C,T]TTTACCCTTTGCTGTCATAGGATAA | 3,275,282 | 51 |
| 7928. | CCTATGTCTTGCCATGCATTCATC[C,T]CTTGAACTTAATTCTAGCCCAAACA | 3,275,928 | 51 |
| 7929. | ATGCTAAGACTGAGTTGACTCACC[T,C]GAGATTGAGTTGACTCACCTACATG | 3,276,066 | 51 |
| 7930. | GATTAAGCAGAAACATTCTATCCT[G,T]ACTGATTCTTCTGTTGGTTTTCTCC | 3,276,237 | 51 |
| 7931. | TTGGTTTTCTCCTTTGACCTCTTG[A,G]TTTCTTCTCATGTGTTTTCAAGGCT | 3,276,275 | 51 |
| 7932. | CCAGACTCAATCTTATAGAAAAGT[A,G]GATCGGATCTACGGCCAAGACTTTC | 3,277,030 | 51 |
| 7933. | TGCTCATACTAGTCTTAAATCACA[G,A]TTTAAAGGTTTAAATAGGTTTGAAT | 3,277,296 | 51 |
| 7934. | GTTTGAATCCTAATGGCATACCTG[G,A]TTTGGGTCGTGTTGGATCCAAATTC | 3,277,338 | 51 |
| 7935. | GAATTGGATGGATTGGATCAGCTA[G,A]TTTGGGTCGTGTTGGATCCAAATTC | 3,277,460 | 51 |
| 7936. | CTATGCCTTCCCGATTAGCGCCCT[C,A]TGTTCGCTGCCTGCAATCTATGAAT | 3,277,532 | 51 |
| 7937. | CCGCTCCTGGTGCACAAAAATTTC[G,A]CTTGGAGGAGAACTAGAGTTGGTGT | 3,278,435 | 51 |
| 7938. | TAACTCCCACGCCCTTGATGCCTT[T,C]CATGCCATCACCCACATTAAGGGCT | 3,278,660 | 51 |
| 7939. | GCTAGTCCGAGACCGTTCAAGGGG[G,T]CAAACCCCTGCACCAACAACCACAA | 3,279,158 | 51 |
| 7940. | CCACAACAGTGAGCATCGCGGTTC[C,G]GACCTCCATCCAACCAAGAATTTGA | 3,279,202 | 51 |
| 7941. | TCACTGCAAGATCCTCAATGTCTT[C,T]CTTCTCGTCGCCACCATTGATGCCC | 3,279,277 | 51 |
| 7942. | GGTAGCCCAACCGTTTCCTAGGCA[A,T]TAAGATGCAACCCCCTTCTATCCGA | 3,281,021 | 51 |
| 7943. | ATCAACATATCAAATAAAAaAaTA[A,G]AAAGGTAACGAAAATTTTTGACGAG | 3,281,602 | 51 |
| 7944. | AAAaAaTAAAAAGGTAACGAAAAT[T,C]TTTGACGAGACCTTCTGATCGGAGT | 3,281,618 | 51 |
| 7945. | TTGACATTATGTAATCATGGAATG[A,G]ACGGTTATACCCATTATTGATCATG | 3,281,941 | 51 |
| 7946. | TCTGCACTGACAGTTTTTGATATA[C,A]TGACTCTACGTTGGTAGTCTGAGTG | 3,282,012 | 51 |
| 7947. | GGATGGAGTTGTCACGTGCTATCT[T,C]GAGCTCTGATTTAACTGTAAACATT | 3,282,455 | 51 |
| 7948. | ATCTTGAGCTCTGATTTAACTGTA[A,G]ACATTAATGATTTCTTCGAAAAATG | 3,282,475 | 51 |
| 7949. | CTGGCGGTAGGTGCGTCAAACCAT[C,T]CGATCGATGGTTGATTTTGATGCAG | 3,282,708 | 51 |
| 7950. | ATATATATAATATCACTTTCATTT[G,A]AATTTTTtATTTTTGTATTTGTCAT | 3,282,824 | 51 |
| 7951. | TGAAGTCCTCTTTGTATTTCCACG[G,A]TCTTCCAAATCATCCCCTAGTTCCG | 3,282,926 | 51 |
| 7952. | GTATTTCCACGGTCTTCCAAATCA[T,C]CCCCTAGTTCCGGGGCATGTTTtTT | 3,282,939 | 51 |
| 7953. | GTCTTCCAAATCATCCCCTAGTTC[C,T]GGGGCATGTTTtTTTtCTTTCTTTT | 3,282,950 | 51 |
| 7954. | TCCTCGAGATAGTCAATCGAAAAA[C,T]CCGATTGACGATTCTCTTTCGGATC | 3,283,085 | 51 |
| 7955. | AAACCCGATTGACGATTCTCTTTC[G,A]GATCGGATATGAAAGTTTCTTCCT | 3,283,106 | 51 |
| 7956. | CCTCTGAGTCAAATAGCAATTTAT[G,A]TAGAGGACCTTCAGGCTGGTCTTCA | 3,283,258 | 51 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 7957. | ACCTTCAGGCTGGTCTTCATTTTT[T,C]GATTCCGAAGTTTATCCAAAATCTC | 3,283,289 | 51 |
| 7958. | TTCGTCTCCATCCAAAAACCAAGG[G,A]TTGGTGGTTCTTCAACTTAAGAAAG | 3,283,467 | 51 |
| 7959. | GAATAAATCCCAACGAACATAGTC[G,A]GATCGATGTTATCAATCGAGAGAAC | 3,283,628 | 51 |
| 7960. | ACTGATGGAGCAATCTCTCTATAA[C,T]GCTGGACTTAGTCTGATGACTTCTC | 3,283,722 | 51 |
| 7961. | TCGATGTTTGCCAACATGTTGCTA[A,C]GAAGAAAGCAGTGATCGATGCTGGA | 3,284,885 | 51 |
| 7962. | TATCACACTGTCAGCTCCAACAGT[G,A]CTTCCTCCAATCGATGTACCATCGA | 3,284,032 | 51 |
| 7963. | AGTGCTTCCTCCAATCGATGTACC[A,G]TCGATCAAAGTGAAATTAACCAGAG | 3,284,053 | 51 |
| 7964. | TTCAACTGGGCCGATGCTGTTTCA[A,G]GTGCCATTAACTTCTGACTTCATGA | 3,284,242 | 51 |
| 7965. | AGCTGTTTCTGTCGATGATGGATC[A,G]TCAACAAGCTTCACCGTGCTTTTTG | 3,284,338 | 51 |
| 7966. | GACGTAAGTTGATGATACTTTTCT[G,A]ATACTCTTCTATTTTTTGTTTTtGT | 3,284,537 | 51 |
| 7967. | CATCGAAAAATTATCGAGTTTCAT[T,C]GAGCATGGATGGATAAAACTACAGC | 3,284,652 | 51 |
| 7968. | AAGAACAAAAAGCACTCAATCAAA[C,T]GGCTTCGAAGGGAGTGTGATGGCTG | 3,284,886 | 51 |
| 7969. | AGCAGCATCGTTGCCCTTGGTTCG[G,A]GGAAGAGATTGCCGAGGAGATTGCA | 3,285,186 | 51 |
| 7970. | TGCCCTTGGTTCGGGGAAGAGATT[G,A]CCGAGGAGATTGCACCAACTGAAGA | 3,285,197 | 51 |
| 7971. | AGATTGCTAATTATCAATCGGTGT[G,A]TTGAATGTCGATCAGTAGTCATAGT | 3,285,562 | 51 |
| 7972. | CTAGTCGGATATCACCTGACTTAG[A,C]TTTTAAATAATTTTTTtAAAATAT | 3,285,627 | 51 |
| 7973. | TTTGATCTAAAGATTTTGAAACTT[C,T]TGTCTTTCTTAAGACTAGGTCTCTT | 3,286,125 | 51 |
| 7974. | TGGCTCATTATATTGGTCGACTCT[C,T]ACTGACAGCAATCCAATCTCGAGCA | 3,286,312 | 51 |
| 7975. | AATTAAATGGCAATTCTCCTATTG[G,C]TATATGTAGAGTTGTCCGATATACT | 3,286,389 | 51 |
| 7976. | GCCTTAAGACCATGTAGAATTATT[C,T]GATTTGTCACTTTCACTTCATCGTT | 3,286,493 | 51 |
| 7977. | TCGTTAGATTATGGATGACCGACA[T,G]AAGTGAGTTTGTACGTAATGTGAAG | 3,286,538 | 51 |
| 7978. | CATTATCGGTGATGATGGTGTGTG[G,A]TAAATCGAATCTACATATGATTGAT | 3,286,632 | 51 |
| 7979. | CTTTCATCTTATTTTCAGTGATTT[G,A]TGTCAAAGGTTGCGGCTTCCATCCAT | 3,286,695 | 51 |
| 7980. | CTGACTGGTCGGTTGATGTTGTAT[G,A]TTGGCATACTTCTGACATGATTTAT | 3,286,864 | 51 |
| 7981. | TTGATGTTGTATGTTGGCATACTT[C,T]TGACATGATTTATATTTTCCAAAAA | 3,286,876 | 51 |
| 7982. | ACTTCTGACATGATTTATATTTTC[C,A]AAAAATTTAGCTGCATCTTTCTTT | 3,286,896 | 51 |
| 7983. | GGTGGGCCAATAATATCCTTATCG[C,T]AAAACTTTATAAGCCAATGATTTAT | 3,286,948 | 51 |
| 7984. | ATGATTTATCCTCCTAAGTAATTT[C,T]CACAAATTCCTTCGTAAACTTTTCG | 3,286,989 | 51 |
| 7985. | ATTTATCCTCCTAAGTAATTTCCA[C,T]AAATTCCTTCGTAAACTTTTCGGAG | 3,286,992 | 51 |
| 7986. | CTTTAGTAAGGGAAGAGAGAATGA[C,T]CTTTTATAAAGTTATTCATTCATCA | 3,287,072 | 51 |
| 7987. | ATTATGAGGCCGTCCACCTTAGTC[G,A]TTTGATCTCTGAAAGATCTGTAGGT | 3,287,128 | 51 |
| 7988. | TTGGTTCATCATTAATTTGTAGCA[T,C]TTTATCAATTTTATCAATACTCGAT | 3,287,221 | 51 |
| 7989. | GATATTTAATGAAAACGTACGGTCGA[A,G]CGAGCTGAATGAGGAAGTTGCGAGT | 3,287,278 | 51 |
| 7990. | AGCTGAATGAGGAAGTTGCGAGTC[G,A]AAAAAATGCATTAGCTTGAGCATTC | 3,287,305 | 51 |
| 7991. | ATTAGCTTGAGCATTCTCTATTTT[C,T]GAGATGTGAGAGATCTCGAAAGTATT | 3,287,339 | 51 |
| 7992. | CTTTTACTTTCTGAAGATACATCA[T,C]AATAGAATTTCGGGCTCCAAATTCA | 3,287,407 | 51 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 7993. | TACTTTCTGAAGATACATCATAAT[A,G]GAATTTCGGGCTCCAAATTCATTCT | 3,287,411 | 51 |
| 7994. | TAATATAAAATTGCTCTCAATGGT[C,T]GATCTGTTAAGACAACTATTGGATG | 3,287,892 | 51 |
| 7995. | AGCCTTTATGTTACATTTGATTT[G,A]TGTCTTGAACAGTCTGTTGACTAGC | 3,288,568 | 51 |
| 7996. | TAAAGGCAGTATGCTTCTCATCTT[C,T]AGGTGTCATTCGAATTTAGTTGTAG | 3,288,675 | 51 |
| 7997. | ATCGATTTTTGATAAAGAAAAGAT[G,A]TTTTTCAGACAAACTTCATTTAAAT | 3,288,784 | 51 |
| 7998. | AAGAAAAGATGTTTTTCAGACAAA[C,T]TTCATTTAAATTGGTATAGTTGATG | 3,288,798 | 51 |
| 7999. | TTACTATATTATGAAGCTAATCTG[G,A]ATAGTTAGCTTCTCTTATGAAGTCA | 3,288,882 | 51 |
| 8000. | TCAAGTAAAAATGTTGGCATTTGC[T,C]CTTAGTAGGTTCACTAGTTATTTTC | 3,289,084 | 51 |
| 8001. | ATGGTATGTTGATACTATTGCTCT[C,T]AAGACATTAAGTCCTGATCATCCAA | 3,289,381 | 51 |
| 8002. | TGTGGTTGAGGTTGTCGGTCAGTG[G,A]GAAGTTGAATCAGGCAGTCTTGTTA | 3,289,891 | 51 |
| 8003. | ATCGTGACCGTGATCATGATAAAA[C,T]CGACAATACTtTTTTTTGTCGCAGC | 3,290,010 | 51 |
| 8004. | TACTtTTTTTTGTCGCAGCTCCTC[G,A]GTGGTGCTTTCATCGATGGGGATG | 3,290,041 | 51 |
| 8005. | ACTtTTTTTTGTCGCAGCTCCTCG[G,A]TGGTGCTTTCATCGATGGGGATGA | 3,290,042 | 51 |
| 8006. | TCCCTCAATCTCTATTAGGATCTA[C,T]ACATGAAGAGCAAAAAGAAAAATAT | 3,290,106 | 51 |
| 8007. | GGAGTCATACCTGCTATCATAATT[G,A]TTCGATCTTGGACTCCATCGATGGA | 3,290,157 | 51 |
| 8008. | GTCATACCTGCTATCATAATTGTT[C,T]GATCTTGGACTCCATCGATGGAGTG | 3,290,160 | 51 |
| 8009. | TTGTTGATCGATTTGGTTCGATCG[G,A]AGCTTCATCTTTTtTTTGCTTCTTT | 3,290,225 | 51 |
| 8010. | TTTTGATATTTTTTTTtGCTTGAC[G,A]TTGGTCAGAAGTATCCTCATTCATG | 3,290,275 | 51 |
| 8011. | GGACCACGAACAAATGTTTGAGCT[G,A]CTCAAAAAAATTTATGCTCCCCGGT | 3,290,578 | 51 |
| 8012. | GCTCAAAAAAATTTATGCTCCCCG[G,A]TTGGAGCCCAGAATACCAGACTCGA | 3,290,602 | 51 |
| 8013. | AGGACTTCCAGCCTTCCACTTGGA[G,A]TCGGAGGAGTTGACAATCGATCTTT | 3,290,865 | 51 |
| 8014. | CCACTTGGAGTCGGAGGAGTTGAG[A,G]ATCGATCTTTTTAAATTTGTGCTCG | 3,290,880 | 51 |
| 8015. | GTTGTTGCTGGAAAAATTCAGGGG[C,T]AGTCACCTGAAGAACTTAAGGATTG | 3,290,943 | 51 |
| 8016. | CTGTATTAAAGTAGTAATTTGAAC[G,A]TCTGCAGTGACTACAGGATGTGAAG | 3,291,293 | 51 |
| 8017. | CCTATGGAGTTATTTTGAGCTCTA[G,A]TTTTTACCATAATTTTTTGTAAGCC | 3,291,408 | 51 |
| 8018. | AAATTATGTCCGACAAAGATCTTT[C,T]GATGCTTAAGTTAGTGAAGAGTAGT | 3,291,549 | 51 |
| 8019. | TTAGCCTAGAAGTATCTTACCAAT[A,G]CTGTTCATTTACCTCCTTTTTATAG | 3,291,631 | 51 |
| 8020. | GAAGTCGGTTAAGTCACCATGGTT[T,G]AATTGTATTTGCCAGCAAAGTTGAG | 3,291,933 | 51 |
| 8021. | TGCCAGGAAAGTTGAGAATAGCTG[A,G]CTGTTGATCGGCTTACTGATTGATA | 3,291,967 | 51 |
| 8022. | ATGTAGCTTTGATGGTTTATCATC[A,C]ATAATCGATAGATATCCGATCGACC | 3,292,091 | 51 |
| 8023. | GTCATAACAATAAATAAAAAAaGC[C,T]AGTGAATCTTGTCATAGGCCTCCTC | 3,292,263 | 51 |
| 8024. | AGAAAGAGGTACTTTGTGCAGTGA[A,C]TGCAATATTTCATAGGCAAAAAAGG | 3,292,347 | 51 |
| 8025. | GACAATCTTATAAGGAGAATTGCA[C,A]AAGCCAATTGGTCTATAATCTGTAG | 3,292,497 | 51 |
| 8026. | TTTGAAAATGTCGCATAAGGACTT[G,A]CTGGATTAGGTGTTGATCTTCCACC | 3,292,859 | 51 |
| 8027. | GATCTTCCACCTTTTCTCCATCCT[C,T]ATTTTTTATAGAATGAATTTTATTA | 3,292,898 | 51 |
| 8028. | CCTATTGTTCCACCAAGTATAATT[A,G]GGCCCTCAATAGCCTACATTAATCA | 3,293,511 | 51 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 8029. | TCTGTTGGGAATAGTGTCCCAAAG[C,T]CAATTGTTAGCCTGTTGACAGTTGT | 3,293,579 | 51 |
| 8030. | TGGGAATAGTGTCCCAAAGCCAAT[T,C]GTTAGCCTGTTGACAGTTGTGCTCC | 3,293,584 | 51 |
| 8031. | GAATAGTGTCCCAAAGCCAATTGT[T,C]AGCCTGTTGACAGTTGTGCTCCTTT | 3,293,587 | 51 |
| 8032. | TATGTACAGTCGTGTTTCAATTTA[T,G]CAAAATCTTGGCCAGGGTAGTCCTA | 3,299,964 | 51 |
| 8033. | CAGTCGTGTTTCAATTTATCAAAA[T,C]CTTGGCCAGGGTAGTCCTAGTGAAG | 3,299,970 | 51 |
| 8034. | CAGGGTAGTCCTAGTGAAGAGTCA[T,C]AGGACTAATTGAGTTGAGCACGATT | 3,300,001 | 51 |
| 8035. | TGAGTTGAGCACGATTCGGATGAT[C,A]TCATCAGGGTTGACAGTTTAACCCT | 3,300,035 | 51 |
| 8036. | TTCCTAAACACAGGGGTCAAAAGG[A,G]ATGAATTATACGGTAACCATATTCA | 3,300,090 | 51 |
| 8037. | TATACGGTAACCATATTCACGTAG[A,G]TTCTGAATGTTGCGATTGCGACTAT | 3,300,121 | 51 |
| 8038. | CGTAGATTCTGAATGTTGCGATTG[C,T]GACTATTCGATCTATCCGATCGTCG | 3,300,140 | 51 |
| 8039. | TCCTTTCTGATCTGATGGCTGATT[T,A]TGAGTCTTATGTATCTGGGACTCTA | 3,300,286 | 51 |
| 8040. | CTGGGACTCTATGATTGAGAATTA[A,G]GATTCTTTGATCATGAGTTCCACAC | 3,300,325 | 51 |
| 8041. | TCTATGATTGAGAATTAAGATTCT[T,C]TGATCATGAGTTCCACACATTTTGG | 3,300,332 | 51 |
| 8042. | ATGAGTTCCACACATTTTGGATAC[T,C]GGGGTCAAAATTTTGAATTTCAAAT | 3,300,362 | 51 |
| 8043. | AATTTGATTGAGTAATTATTTTTA[A,G]ATGAAGTCCAATTGAATTGGATTCA | 3,300,540 | 51 |
| 8044. | TTGATTGAGTAATTATTTTTAAAT[G,C]AAGTCCAATTGAATTGGATTCAGTT | 3,300,543 | 51 |
| 8045. | GAGTAATTATTTTTAAATGAAGTC[C,T]AATTGAATTGGATTCAGTTTGGATT | 3,300,549 | 51 |
| 8046. | AATTGGATTCAGTTTGGATTGACC[T,C]GATTAGGTTAAGTGTTGATCTAATC | 3,300,579 | 51 |
| 8047. | AGGGGGCGTGGGCAATGAAAGAAA[T,G]AAGAAATAAGGGGCGTGGGGAGGTT | 3,300,755 | 51 |
| 8048. | GCGTGGGCAATGAAAGAAATAAGA[A,G]ATAAGGGGCGTGGGGGGGTTCTAGA | 3,300,760 | 51 |
| 8049. | AAATAAGGGGCGTGGGGAGGTTCT[A,G]GAAAAATTTTGAAGTGTTCAAAATT | 3,300,783 | 51 |
| 8050. | GAGAGAAAAGGAGAGAGAAGTGGG[C,T]GCAGGGTTTTTGGTGTGTACCCTAG | 3,300,842 | 51 |
| 8051. | TTTTGGTGTGTACCCTAGGGTTTC[T,A]ACTTAGGGTTCAGGAAGTGAGATTG | 3,300,874 | 51 |
| 8052. | TGGTGTGTACCCTAGGGTTTCTAC[T,C]TAGGGTTCAGGAAGTGAGATTGGTA | 3,300,877 | 51 |
| 8053. | CCCTAGGGTTTCTACTTAGGGTTC[A,G]GGAAGTGAGATTGGTATGCCACGAG | 3,300,886 | 51 |
| 8054. | TCCATCAGCCTCTCAACCAACCAT[G,A]CAGATGATCCAAAGCATCCGAGGAG | 3,300,967 | 51 |
| 8055. | GATCCAAAGCATCCGAGGAGTCAG[G,C]ACATATCGATCGAAGGAGTTCGATC | 3,300,997 | 51 |
| 8056. | CAAAGCATCCGAGGAGTCAGGACA[T,C]ATCGATCGAAGGAGTTCGATCAACA | 3,301,001 | 51 |
| 8057. | CGATCAACATCAGCCATCAAAAGG[A,G]TGAAATCACGAACTAGCATTCGTGA | 3,301,042 | 51 |
| 8058. | GCATTCGTGAGGAGCCGATCAGAC[A,G]GGAGCTTTGTGTGGATGATCCGCAG | 3,301,082 | 51 |
| 8059. | GAGGAGCCGATCAGACAGGAGCTT[T,C]GTGTGGATGATCCGCAGAGGCCAGA | 3,301,090 | 51 |
| 8060. | GATCAGACAGGAGCTTTGTGTGGA[T,C]GATCCGCAGAGGCCAGACACTAGTG | 3,301,098 | 51 |
| 8061. | ACAGGAGCTTTGTGTGGATGATCC[G,A]CAGAGGCCAGACACTAGTGTGGCTG | 3,301,104 | 51 |
| 8062. | TCGACTACCCGCAAAAGGTGATGT[G,A]TTCTGAACACAGTACAGTAAAAAGT | 3,301,199 | 51 |
| 8063. | TTTGAATTTCAAATTTAAATGCAT[G,A]CTGTTGTATCATATTTAGATCCTAG | 3,301,262 | 51 |
| 8064. | ATGAGATTAATTAATAATTTTACT[A,G]TAAAATAATAATTATGAAAAaGTTT | 3,301,335 | 51 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 8065. | AATTAATAATTTTACTATAAAATA[A,G]TAATTATGAAAAaGTTTTAAAAaTT | 3,301,343 | 51 |
| 8066. | TAATTTTACTATAAAATAATAATT[A,T]TGAAAAaGTTTTAAAAaTTATCATT | 3,301,349 | 51 |
| 8067. | CCTATTAGGAAATGTTAAGATGCA[C,T]AGCAGAAAAATAATAATAACTTTTC | 3,301,929 | 51 |
| 8068. | AATTTTTTATTTATGTATATAGCA[G,A]AAAATAATTTTAGATTTAAATAATT | 3,303,152 | 51 |
| 8069. | TCCATCATAAATATCATTGAAATC[C,T]ATTTCAATAGATTGAAACACTTCCA | 3,304,375 | 51 |
| 8070. | CTTGGTGTGTTAACGTGTGATTCA[G,A]TTCTTTTATCATGAGTTCTGATAAG | 3,304,538 | 51 |
| 8071. | TAAGATGGAGATCATGAAAAACTC[G,A]TCAAACCTCATCATATATCATATAT | 3,304,584 | 51 |
| 8072. | CAGCTCAAGTTCAACTCGTGATTT[T,C]TCATAAAAATTTCTTTCCATCAATC | 3,304,644 | 51 |
| 8073. | CTCAAGATGTTGAGAATTTGAGAC[G,A]TACATCATTAGTAGTTAATTTTTAA | 3,304,959 | 51 |
| 8074. | TGCTTTCGATTGAAGGATCGTCAC[G,A]AAGGATGGTGATCAATCCATTCAAA | 3,305,010 | 51 |
| 8075. | CGATTGAAGGATCGTCACGAAGGA[T,C]GGTGATCAATCCATTCAAAATTGGT | 3,305,016 | 51 |
| 8076. | CCTCTCTTTGGGGCAGATAAGTCT[C,T]GAGTCTATGGTGTAGAGATACTAAG | 3,305,076 | 51 |
| 8077. | CTGAGCGTGATCAATACAAAAAAT[T,C]ACTTGGATGTCTACTCACTCATCAG | 3,305,162 | 51 |
| 8078. | GTTTGACTGCACATTCTCTTAGTC[T,C]CTAGCCATTCAGGTTCTTATTATAT | 3,305,289 | 51 |
| 8079. | TTCAGGTTCTTATTATATATGTTG[G,A]CTATTGTAGGTTCAGATTCGTTATT | 3,305,321 | 51 |
| 8080. | TTCTTATTATATATGTTGGCTATT[G,A]TAGGTTCAGATTCGTTATTTGAAGT | 3,305,327 | 51 |
| 8081. | AGAAAATCTCTGGCCAGACTAAGT[G,A]TGAATACTGAAAAAGAGTTTTCATA | 3,305,451 | 51 |
| 8082. | TGAATACTGAAAAAGAGTTTTCAT[A,G]GATTTACAAATGAACTCAAGTCAA | 3,305,476 | 51 |
| 8083. | TTTGACGAGTTCTCCATGACCTCC[G,A]TCAAGTCGAAACTCATAATAGAGAA | 3,305,555 | 51 |
| 8084. | ATATGATAACTACACCTAAGGGTT[C,T]ATTTtTTTATTCTACTAGATTATCA | 3,305,613 | 51 |
| 8085. | TTAAATTTTAAAAATTGCTAATTT[G,A]TAATTGTTATAATTTTGGTAGCTGC | 3,305,908 | 51 |
| 8086. | AGCTTTTTGAATTCGACTTGATTC[G,A]GACTCAATTTGAATCCGATTAAGAC | 3,306,148 | 51 |
| 8087. | AGGTCTTGCGTGAACAAGAAGTGC[G,A]ACTTTTTTAGGACATCACAATCCTT | 3,306,659 | 51 |
| 8088. | CAGAGAGAAAAAGAGAAGAATAAG[A,G]AATTTTCTTCTCTTCATGGTGATCT | 3,306,785 | 51 |
| 8089. | AGATCTAGATCCAAAGTTGAGGAG[C,T]GAGATCTATAAAGTGCTAGCACATC | 3,306,905 | 51 |
| 8090. | GTGTGCAGCTACGATTAGAATTCG[G,A]ATATCCGCATATCCAAGGTATAGAG | 3,307,013 | 51 |
| 8091. | CCATTCGATGGGTTCTCTCTTATG[A,G]CGTGTAGGGGTATCGACTGTGATAT | 3,307,808 | 51 |
| 8092. | TTCTCTCTTATGACGTGTAGGGGT[A,G]TCGACTGTGATATTTTTCATGAAGA | 3,307,820 | 51 |
| 8093. | GACATACGATCTAAAACTTAATTT[C,T]TGTAAAATTTTAGATCCAAAATCCT | 3,307,982 | 51 |
| 8094. | AGGTCAGCTCACTTACTGATGAGC[C,G]AACTCAATTGTGCAGGTTAGGTCAC | 3,308,162 | 51 |
| 8095. | GGTCAGCTCACTTACTGATGAGCC[A,G]ACTCAATTGTGCAGGTTAGGTCACA | 3,308,163 | 51 |
| 8096. | CTTAAACCCATGTACATAATGCAG[T,C]TAATTGAGAATTAATATTTGAAATT | 3,308,358 | 51 |
| 8097. | CATGTACATAATGCAGTTAATTGA[G,A]AATTAATATTTGAAATTATAAAATC | 3,308,366 | 51 |
| 8098. | ATTAATATTTGAAATTATAAAATC[T,A]AAAATTATGAATTTAAGATCTAAAT | 3,308,392 | 51 |
| 8099. | ATTATGAATTTAAGATCTAAATTT[T,C]AATACATAAAATATGAGTTTCAGGT | 3,308,420 | 51 |
| 8100. | CCAATTTGGTATCTAAGACAAGTA[C,T]TAGATAGTGATTATTTAATTGATTC | 3,308,730 | 51 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 8101. | CATTGGTGTTTAAGAAAAGCAACG[G,A]AGAAACCTTACTCATCTTTATTTGT | 3,308,801 | 51 |
| 8102. | GAGAAACCTTACTCATCTTTATTT[G,A]TCTGATCATTTTGAAAGATTATATT | 3,308,825 | 51 |
| 8103. | TATATTTTGTATTAGGTTACTTGT[A,G]GATCCGAGTTCACCCATGCCAACTA | 3,308,869 | 51 |
| 8104. | TGTAGAGATGTGGGTGTCTTTTTC[G,A]ACGTTGATCGTTCTCGACTAGTTAC | 3,309,046 | 51 |
| 8105. | TAGAGATGTGGGTGTCTTTTTCGA[C,T]GTTGATCGTTCTCGACTAGTTACAG | 3,309,048 | 51 |
| 8106. | AAGAAATATGCCAATAACTGTTAG[G,A]TGAGACCACAGGACTTAGAGATCCA | 3,309,242 | 51 |
| 8107. | AATAACTGTTAGGTGAGACCACAG[G,A]ACTTAGAGATCCAGTCGCTGCAACA | 3,309,254 | 51 |
| 8108. | ACAGGACTTAGAGATCCAGTCGCT[G,T]CAACATGCTTGGAGAAGCATCTGGA | 3,309,274 | 51 |
| 8109. | GAAGCATCTGGATAAAGAGTTGTC[C,T]ACATATTGATATACGTGTTATCAAT | 3,309,312 | 51 |
| 8110. | TTATCAATAACTGTTAGGTGAGGT[G,A]CCGTATATCGATAGGACCACAACAT | 3,309,354 | 51 |
| 8111. | CGTGTTAGGATTTTCTTCTCCATC[C,T]GAGTGTGAGAGACTCGAAAAATTAG | 3,309,421 | 51 |
| 8112. | AAAATTAGTGAGAGCCTTTGTTTG[T,C]TTTTAAAGTCCTTAGATCAAATTAT | 3,309,463 | 51 |
| 8113. | AGAGCCTTTGTTTGTTTTTAAAGT[C,T]CTTAGATCAAATTATTACAAGTACA | 3,309,473 | 51 |
| 8114. | CTTTACTCTCTATGATCAATTTTT[T,C]AGCTTCCAACACTCAAGCTCGAATC | 3,309,538 | 51 |
| 8115. | CAATAGTTGTAAGATGATCAGAGT[C,T]GCACAGTGCATGAGATGCATGATCG | 3,309,857 | 51 |
| 8116. | AATAAATATTATAACATCTTAATT[G,A]AATTGGTCGATATGCTGGTAACTAA | 3,310,042 | 51 |
| 8117. | TCAAATTACTCAAAATTGATATTA[C,T]AATTTTTTtCTTTTTCATTAGACTC | 3,310,164 | 51 |
| 8118. | AATGATGCAAATATTGCACTGAGA[C,T]CGTGAGTACCTAATCTCAGTGATTA | 3,310,295 | 51 |
| 8119. | ACCTAATCTCAGTGATTATCATTT[G,A]GATTTAATTCTTTATCATTTGCATG | 3,310,327 | 51 |
| 8120. | GCTAAGTCATGTATGAGAAGAAAT[G,A]ATTTGCCGACCGAAGAAAATGGGCT | 3,310,475 | 51 |
| 8121. | GTATGAGAAGAAATGATTTGCCGA[C,T]CGAAGAAAATGGGCTTTTTGGGCTC | 3,310,485 | 51 |
| 8122. | TCATATCTAGTCTACAAATCATCT[C,A]TTTGAGGATTAATGACTAAACTGTC | 3,310,548 | 51 |
| 8123. | GAGATACTTATCTTAGTACACATA[C,T]AATATGCATGGCCTATTTGATGAAC | 3,310,626 | 51 |
| 8124. | AGATTTTGAAAGGTTCAAAGAATT[T,C]AGGTGTAAAGTAAAAAGATAAATG | 3,310,759 | 51 |
| 8125. | AAGATACTTTGATCAGATCGAGGA[T,C]GCAATACCAAATGGAGAATTTATCG | 3,310,821 | 51 |
| 8126. | ATTTAATTTTTGAAATTTAAATTA[T,G]ATTTCCTCTGAAGTTGGTTTCACCA | 3,311,023 | 51 |
| 8127. | ATATGATATGGTGGACAGGTTAGA[A,G]AATAGGTCTGTGAGAACTCATTTAT | 3,311,084 | 51 |
| 8128. | GGAATGATCCCAAAAGTCCTACAA[C,T]GATGTGATATGAAGAATCATGTAGT | 3,311,421 | 51 |
| 8129. | TAGGAGAGTCCCATACTGACATCG[G,A]TTAAGATATGGTTATATATAGAATT | 3,311,485 | 51 |
| 8130. | AGAGGGATCCATTATCCTCTTAGG[C,T]ATGGGTGTATACAATGCTATGTACT | 3,311,667 | 51 |
| 8131. | ATTATTCCTCATCTTTGAAGAAGG[G,A]TTAGAGTTAAGAGTGGGAGGATACA | 3,311,828 | 51 |
| 8132. | TTGGAAGGGTTTTAGGCAATCAAC[T,C]AATGAAAGCTGAATATGCTATAGAT | 3,311,940 | 51 |
| 8133. | AGATGTGTAGAATGCATTCTGGTT[C,T]TTATGATAGTTACAGAACTGGATGT | 3,311,986 | 51 |
| 8134. | GGATGTCATACCATTGGATGCTTT[G,A]ACATTATACTACAAAGATAATGATC | 3,312,030 | 51 |
| 8135. | GACAGATTGGCTTTAGTGCAAGTG[G,A]AACCTTTTTAGATGTGTGTTCTAGA | 3,312,268 | 51 |
| 8136. | TGCAAGTCCAACCTTTTTAGATGT[G,A]TGTTCTAGAAGCCAATCTTGGCTAA | 3,312,284 | 51 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 8137. | AAGCCAATCTTGGCTAACACATAC[C,T]TTTCTCTAAGGCATGTTTTGTACTT | 3,312,317 | 51 |
| 8138. | ATCTTGGCTAACACATACCTTTCT[C,T]TAAGGCATGTTTTGTACTTGATGGG | 3,312,323 | 51 |
| 8139. | GGCTAACACATACCTTTCTCTAAG[G,A]CATGTTTTGTACTTGATGGGTAGTC | 3,312,328 | 51 |
| 8140. | ATACTTTCAATCGAAGGATCATCA[C,T]GAAAGATAATGATCAATCCATTTAA | 3,312,497 | 51 |
| 8141. | CACTGAGCATAACCAACATGAAAA[T,A]CCATTTGGATGTCTACTCACTCATC | 3,312,648 | 51 |
| 8142. | TCGTAGTGAGGCTACTTAGTTTGA[C,T]TGCACATTCTCTTGATCCCTAACCA | 3,312,759 | 51 |
| 8143. | ATCATGGTGTGTCTCACTACCAGA[C,T]AGAATAGAATTTGAGAGATCATGCA | 3,313,863 | 51 |
| 8144. | ACAGAATAGAATTTGAGAGATCAT[G,A]CATAAAAGGAGCATGATCTGATCAA | 3,313,886 | 51 |
| 8145. | TGGATCATATTCAAATTATTAATC[G,A]GATTGATAGTTTGAATTTTAGAAAC | 3,313,941 | 51 |
| 8146. | CTCGATTTGAATCCGATTAAGATC[C,T]AACTTGAACTAGAAGAATCATGACT | 3,314,225 | 51 |
| 8147. | GGATAAGGAGGGCGTGCGTTAATT[G,A]TGAGTGGAGGTTTCTTTCTTACATC | 3,314,505 | 51 |
| 8148. | GTGTGACAAAAATAAAAaGGAAGG[T,C]GTGAGGTCTTGTGTGAATAAGAAGT | 3,314,669 | 51 |
| 8149. | AAGAGAGAGAAGAAGAGAAGAAAA[A,T]TTTTTTtCTTTTCTTCATGGTGAT | 3,314,821 | 51 |
| 8150. | CGAATCTACACAAAATAGTTCACG[T,C]GGTGATCTCCTTCTTCAAGATCTAG | 3,314,887 | 51 |
| 8151. | TTCAAGATCTAGAAGAAGAGATCT[A,C]GATCCAAAATTGAGGAGTGAGATCT | 3,314,925 | 51 |
| 8152. | TAGCACACCGATGATCTCAGCACT[C,T]TGATCAGATATTTTGTGTGGATAC | 3,314,984 | 51 |
| 8153. | TTTTTAAACTACACGTATGAAATC[G,A]TTGCAATTTTTTAACAGAACCTACT | 3,315,272 | 51 |
| 8154. | GAACCTACTGTAGCCAACATACAC[C,A]GCAAAAATCTATATAACTAGGAGAT | 3,315,313 | 51 |
| 8155. | TTTAGAAATTAACCATCAATGACA[C,T]ATGTCTCAAATTTTTAATTCTTGAG | 3,315,661 | 51 |
| 8156. | TTATTCGACTCAAATTTTTGATAT[G,A]AAAATGGTGAAAATTTTTTTCACTA | 3,316,071 | 51 |
| 8157. | AGAGATCATGTATGTATAATCAAA[C,T]TATAGTAACTTTATTGTAAATAGCC | 3,316,266 | 51 |
| 8158. | ATAGCCGGGGCACGATGGGTCAAA[G,A]GACTAGTCACCCTATTGCAACATCG | 3,316,310 | 51 |
| 8159. | CCTCCTGAGAAATGGAAGTAGTCT[C,T]CTTCGGATCTTTAGTCAATTCTTCT | 3,316,872 | 51 |
| 8160. | TTTTTtGCTTTTGATGAAGTACCA[G,A]TAACCTCAACTTGTAAATAACTAGC | 3,317,174 | 51 |
| 8161. | TTCGAATTTACTTTTTGGACAAAT[T,G]TTCTTGGTAATATCGATCTTCACAC | 3,317,623 | 51 |
| 8162. | AGTCAATATAAAGTATATGAATT[G,A]GTAAATTAATAAAATTATTATTTAA | 3,318,323 | 51 |
| 8163. | CTTAGGACTATTCTAATCGATATA[A,G]GAGGATATATCATTAAGTCCTTAAA | 3,318,433 | 51 |
| 8164. | GATACGCTGTTACTAGGATGATAG[T,C]GTTTATCGAGTGTAGGTCATTGTGT | 3,318,501 | 51 |
| 8165. | TGAAGACACTGGTATGGCATACAA[G,A]TGAGATGTAGGAGTACATTTCATTG | 3,318,585 | 51 |
| 8166. | GCATACAATGAGATGTAGGAGTA[C,T]ATTTCATTGAATGTGACCAACTACT | 3,318,601 | 51 |
| 8167. | CAAGTGAGATGTAGGAGTACATTT[C,T]ATTGAATGTGACCAACTACTGAGTA | 3,318,606 | 51 |
| 8168. | AGGATATGGGTATAAGTATCCCTC[T,C]GATCTAAGATCATCATGGTGACTTA | 3,318,681 | 51 |
| 8169. | CAAGCAACTCATTATACTTTGGTG[T,C]CAGACTATCTGAATTTTTAATTCAG | 3,318,731 | 51 |
| 8170. | TGACCCCTCCGAATAAGAAGAAGT[A,T]AGTGCATCAGTATATTTTAATTCAA | 3,318,844 | 51 |
| 8171. | CTTGAGCATTAGGATCAAAGGGAT[A,G]AATTATATGGTAACCATATGTCAAT | 3,318,990 | 51 |
| 8172. | CCATATGTCAATAGGTTCATGAAT[A,G]ATGCTTTGCAATCTTTCGATCTATC | 3,319,028 | 51 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 8173. | TAAGGTACACTTAAAAGAAATTTT[C,T]AACTAATCATGTAGCTGATCAATGA | 3,319,162 | 51 |
| 8174. | TAATCATTAATTCGATTAACCTTG[T,C]ACAAAAGTAATAATAAATTAATTTG | 3,319,232 | 51 |
| 8175. | TAATTAGATCAGATAATCTAATTA[G,T]ATCTAACATAATTTGGTTGCGTTAA | 3,319,505 | 51 |
| 8176. | TGGGCATCCATGCATGAGAAAAAG[G,A]GGAAGAAGATCCTCTTTGGGGCGTA | 3,320,108 | 51 |
| 8177. | TTCTAATCTGGAGATATCCATTG[A,G]TCTAAAGAAAGGAGTCTCTATCAGC | 3,320,270 | 51 |
| 8178. | CAATGGTGATCGTCGACCCATGAT[C,T]AGGTAATGGGTTCTGAACTCATCGG | 3,320,456 | 51 |
| 8179. | GATGCAGTCTTTTCTTTCTGATCA[A,G]ATTTTTTtTATATATTATTTTCATG | 3,320,550 | 51 |
| 8180. | CAAATTTTTtTATATATTATTTT[C,T]ATGTCATAAATTTTTAGATAGGTAG | 3,320,572 | 51 |
| 8181. | TAAATAGTTTAATCTACTACTTTC[G,T]CTATAAAAaTTTTAAAaAATACATA | 3,320,654 | 51 |
| 8182. | ATTTCTTATGACATGAATTTTTTA[C,T]ATATAATCTGATATTAATCTAATTT | 3,320,745 | 51 |
| 8183. | GTTTTACGATCCTTTCTTTTCATT[C,T]GATGAGATTCTCATATGGCTTGTAG | 3,320,889 | 51 |
| 8184. | ATGAGATTCTCATATGGCTTGTAG[G,A]GATGCTGCGTAGTCTTTTTCATGAA | 3,320,915 | 51 |
| 8185. | CTCGATTCAAATCTATTTAACTGG[A,G]TTAGACCTAGGATTAGAAATCATTG | 3,322,754 | 51 |
| 8186. | TTTTTTGATTAATTCTCAATAGTT[G,A]TAGTTGGTCAAGTCTATGTCTTTGA | 3,322,868 | 51 |
| 8187. | TCATAGCTCTGTAGTCAAACCCAA[G,A]TCTATAAGTTGATCAAGTTGAAACA | 3,322,939 | 51 |
| 8188. | TGAGTTAACGGCATATCCCTCCCA[C,T]CGATCTCACTTATCTGACCAACATG | 3,323,076 | 51 |
| 8189. | TAATTGATTTAGGTGCCCCTAATT[C,T]AACTTGTCTTGAGTCCTCTTCATAA | 3,323,192 | 51 |
| 8190. | TCTGACTTAGTGAAGTCAGTAGGA[G,C]GATTAAAAATAACTGATTGAGTCTT | 3,323,309 | 51 |
| 8191. | CATCTATCAATTCAATTAATTAAA[A,T]TTTTTAAAATTATTAGGTCTCTAAA | 3,323,363 | 51 |
| 8192. | GTCTCTAAATATAAAATAGTTATG[G,A]AGATAACTAGATCATAACCTCCTAT | 3,323,404 | 51 |
| 8193. | GTGATCAGGATGACCGACCAAAGC[T,C]GGATCAAATCACTTATGGTTAGATT | 3,323,575 | 51 |
| 8194. | AGCCGACCAAAGTCGAGCTCATGT[G,A]CAACTATGTGGATTCTAGTATCTGC | 3,323,770 | 51 |
| 8195. | TCAATGCCAGGATGAGGGAGGGGG[C,T]GTCAGTGATCGATCATATATTGTAC | 3,324,316 | 51 |
| 8196. | AAGATCACCAGCTCCACAAAGAGA[C,T]GGTGAATGTAATGGGAGCATCTTCT | 3,324,544 | 51 |
| 8197. | AGTCTGATCAAAGTCAGGCAGAGT[G,A]CTTCTACTATAAGAAGCAAGGTTAT | 3,324,681 | 51 |
| 8198. | TTTTAATTTATGATACAATGATCT[G,A]AGTATTAGATATTGATAGTCCTATT | 3,324,840 | 51 |
| 8199. | AATTCTCATATCATTATTCTTAGT[A,G]ATTATCATTATTGTCCTAGTTTCTT | 3,325,018 | 51 |
| 8200. | TAATTATCATTATTGTCCTAGTTT[C,T]TTATTGAATGTAATTTTTGTAGGCC | 3,325,041 | 51 |
| 8201. | ATAATGTCTTGAAGAGCTATCTTT[G,A]GCATTGTAAGCTAAGTCATATCAAC | 3,325,245 | 51 |
| 8202. | GGTCTTGTATATACTGATGTATAT[G,A]GACCGATGAGCACAAGTATGAGAGG | 3,325,439 | 51 |
| 8203. | ATGGACTCCTCCTAGAATGCCACA[A,G]TATAATGGTATCTCAGAAAGGAGAA | 3,325,711 | 51 |
| 8204. | GGATGTCCGACTTATATCAGATAT[T,C]TAAAAACAGACAAATTAGGATCTAA | 3,325,946 | 51 |
| 8205. | CGACTTATATCAGATATTTAAAAA[C,T]AGACAAATTAGGATCTAAGTCTGAC | 3,325,953 | 51 |
| 8206. | TCTTCATAGGGTATCCTAAAAAAa[C,T]TAAGGGATATTACTTCTACCTTATT | 3,326,010 | 51 |
| 8207. | CTAAGGGATATTACTTCTACCTTA[T,C]TGATAAATAAAATATATTCGTGACT | 3,326,034 | 51 |
| 8208. | GTTCGATGGATAGAAGAACCGACA[C,T]AATCTAGTGAACCCACAGAATCCAA | 3,326,157 | 51 |

TABLE A-continued

Table of SNPs identified in the genomic region (SEQ ID NO: 8218) containing SHP1

| SEQ ID NO: | SNP | position in Genomic region SEQ ID NO: 8218 | Estimated prediction success |
|---|---|---|---|
| 8209. | ACAATCTAGTGAACCCACAGAATC[C,T]AATTTGATTGAATCAAATCTAGAAC | 3,326,180 | 51 |
| 8210. | TAAGTGGCTAGAAGTCATGAAATC[C,T]GAAATAGAGTCCATAAAGGCCAATA | 3,326,384 | 51 |
| 8211. | GAAAGTGGATCTTTAAGAGGAAGA[A,G]GGGCACAGACGGCAAGGTAGAGACC | 3,326,482 | 51 |
| 8212. | AATGAGTCTAAGGTATGCAAGCTT[T,C]AGAGATCCATTTATGGATTGAAGCA | 3,326,754 | 51 |
| 8213. | TGTGTTTTGATAAAGTGATCAGAA[C,T]GTATAACTTTGTTAAGAATGAAAAA | 3,326,824 | 51 |
| 8214. | GAACGTATAACTTTGTTAAGAATG[A,G]AAAAGAATCCTAAATGGGTTAACAA | 3,326,845 | 51 |
| 8215. | ATCCACATACTTCGACATCATGCT[G,A]AAATGGTTTAGTATAAAAAATTTCA | 3,327,084 | 51 |
| 8216. | TGTAGAGTTTATAGACTTCAATTT[T,C]CAATCGAAGCATGATGACATAAGA | 3,327,419 | 51 |
| 8217. | GTGAAACAATCTACTAAAAAAATT[A,C,T]TAAGCAGCACACAGTAGCCGACTCT | 3,327,499 | 51 |

REFERENCES

Beirnaert, A. and Vanderweyen, R. 1941. Contribution a l'etude genetique et biometrique des varieties *d'Elaeis guineensis* Jacq. Pubis. INEAC, Series Ser. Sci. (27):101.

Bhasker, S. & Mohankumar, C. Association of lignifying enzymes in shell synthesis of oil palm fruit (*Elaeis guineensis—dura* variety). 2001. *Indian J Exp Biol* 39: 160-4.

Billotte, N., Marseillac, N., Risterucci, A. M., Adon. B., Brotteir. P., Baurens, F. C., Singh, R., Herran, A., Asmady, H., Billot, C., Amblard, P Durrand-Gasselin, T., Courtois, B., Asmono, D., Cheah, S. C., Rohde, W and Charrier, A. 2005. Microsatellite-based high density linkage map in oil palm (*Elaeis guineensis* Jacq.). Theoretical and Applied Genetics 110; 754-765.

Birchler, J. A., Auger, D. L. & Riddle, N. C. 2003. In search of the molecular basis of heterosis. *Plant Cell* 15: 2236-9.

Cheah, S. C. 1996. Restriction Frarent Length Polymorphism (RFLP) in Oil Palm. Project Completion Report No. 0011/95, 4 Jul. 1996, Malaysian Palm Oil Board (MPOB), Bangi, Malaysia.

Cheah, S. C. and Rajinder, S. 1998. Gene expression during flower development in the oil palm. Project Completion Report No. 0057/98, 16 Jul. 1999. Palm Oil Research Institute of Malaysia (PORIM), Bangi, Malaysia.

Corley, R. H. V. and Tinker, P. B. 2003. Care and maintenance of oil palms. In *The Oil Palm* (4th edition), pp: 287-326. Oxford: Blackwell Science.

Danielsen, F. et al. 2009. Biofuel plantations on forested lands: double jeopardy for biodiversity and climate. *Conserv Biol* 23: 348-58.

Devuyst, A. 1953. Selection of the oil palm (*Elaeis guineensis*) in Africa. *Nature* 172: 685-686.

Dinneny, J. R. and Yanofsky, M. F. 2005. Drawing lines and borders: how the dehiscent fruit of *Arabidopsis* is patterned. *Bioessays* 27: 42-9.

Donough, C. R. and Law, T. H. 1995. Breeding and selection for seed production at Pamol Plantations Sdn Bhd and early performance of Pamol DxP. *Planter* 71:513-530.

Doyle, J. J. and Doyle, J. L. 1990. Isolation of plant DNA from fresh tissue. *FOCUS* 12:13-15.

Ferrandiz, C., Liljegren, S. J. & Yanofsky, M. F. 2000. Negative regulation of the SHATTERPROOF genes by FRUITFULL during *Arabidopsis* fruit development. *Science* 289: 436-8.

Godding, R. 1930. Observation de la production de palmiers selectionnes a Mongana (Equateur). *Bull Arig. Congo belge* 21: 1263.

Gschwend, M. et al. 1996. A locus for Fanconi anemia on 16q determined by homozygosity mapping. *Am J Hum Genet* 59: 377-84.

Gu, Q., Ferrandiz, C., Yanofsky, M. F. & Martienssen, R. 1998. The FRUITFULL MADS-box gene mediates cell differentiation during *Arabidopsis* fruit development. *Development* 125: 1509-17.

Hardon, J. J., Rao, V., and Rajanaidu, N. 1985. A review of oil palm breeding. In Progress in Plant Breeding, ed G. E. Rusell, pp 139-163, Butterworths, UK.

Hartley, C. W. S. 1988. The botany of oil palm. In *The oil palm* (3rd edition), pp: 47-94, Longman, London.

Huang, H., Tudor, M., Su, T., Zhang, Y., Hu, Y., and Ma, H. 1996. DNA binding properties of two *Arabidopsis* MADS domain proteins: Binding Consensus and Dimer Formation. *The Plant Cell* 8: 81-94.

Immink, R. G., Kaufmann, K. & Angenent, G. C. 2010. The 'ABC' of MADS domain protein behaviour and interactions. *Semin Cell Dev Biol* 21: 87-93.

Jack, P. L., James, C., Price, Z., Rance, K., Groves, L., Corley, R. H. V., Nelson, S and Rao, V. 1998. Application of DNA markers in oil palm breeding. In: 1998 International Oil Palm Congress—Commodity of the past, today and future, Sep. 23-25, 1998, Bali, Indonesia.

Krieger, U., Lippman, Z. B. & Zamir, D. 2010. The flowering gene SINGLE FLOWER TRUSS drives heterosis for yield in tomato. *Nat Genet* 42: 459-63.

Lander, E. S. and Botstein, D. 1987. Homozygosity mapping: a way to map human recessive traits with the DNA of inbred children. *Science* 236: 1567-70.

Latiff, A. 2000. The Biology of the Genus *Elaeis*. In: *Advances in Oil Palm Research*, Volume 1, ed. Y. Basiron, B. S. Jalani, and K. W. Chan, pp: 19-38, Malaysian Palm Oil Board (MPOB).

Liljegren, S. J., Ditta, G. S., Eshed, Y., Savidge, B., Bowman, J. L., Yanofsky, M. F. 2000. SHATTERPROOF MADS-box genes control seed dispersal in *Arabidopsis*. *Nature* 404: 766-770.

Maria, M., Clyde, M. M. and Cheah, S. C. 1995. Cytological analysis of *Elaeis guineensis* (*tenera*) chromosomes. *Elaeis* 7:122-134.

Mayes, S., Jack, P. L., Marshall, D. F. and Corley, R. H. V. 1997. Construction of a RFLP genetic linkage map for oil palm (*Elaeis guineensis* Jacq.). *Genome* 40:116-122.

Moretzsohn, M. C., Nunes, C. D. M., Ferreira, M. E. and Grattapaglia, D. 2000. RAPD linkage mapping of the shell thickness locus in oil palm (*Elaeis guineensis* Jacq.). *Theoretical and Applied Genetics* 100:63-70.

Ooijen, J. W. V. 2006. JoinMap 4.0: Software for calculation of genetic linkage maps. In experimental populations. Kyazma B. V., Wageningen, Netherlands Pinyopich, A. et al. 2003. Assessing the redundancy of MADS-box genes during carpel and ovule development. *Nature* 424: 85-8.

Purseglove, J. W. 1972. Tropical Crops. Monocotyledons. Longman, London. pp: 607.

Rajanaidu, N., Rao, V., Abdul Halim, H. & A. S. H., O. 1989. Genetic resources: New developments in Oil Palm breeding. *Elaeis* 1: 1-10.

Rajanaidu, N. 1990. Major developments in oil palm (*Elaeis guineensis*) breeding. In Proceedings of the 12th Plenary Meeting of AETFAT, pp: 39-52. Hamburg, Germany.

Rajanaidu, N. et al. 2000. in *Advances in Oil Palm Research* (eds. Basiron, Y., Jalani, B. S. & Chan, K. W.) 171-237 (Malaysian Palm Oil Board (MPOB), Bangi, Selangor).

Sambrook, J., Fritsch, E. F. and Maniatis, T. 1989. Molecular cloning: A Laboratory manual, (2nd edition). Cold Spring Harbor Laboratory Press, Cold Spring Harbor, N.Y.

Singh R, Tan S G, Panandam J M, Rahman R A, Ooi L C L, Low E T L, Sharma M, Jansen J and Cheah S C. 2009. Mapping quantitative trait loci (QTLs) for fatty acid composition in an interspecific cross of oil palm. *BMC Plant Biology* 9: 114.

Sousa, J., Barata, A. V., Sousa, C., Casanova, C. C. and Vicente, L. 2011. Chimpanzee oil-palm use in southern Cantanhez National Park, Guinea-Bissau. *Am J Primatol* 73: 485-97.

Tani, E., Polidoros, A. N. & Tsaftaris, A. S. Characterization and expression analysis of FRUITFULL- and SHATTERPROOF-like genes from peach (*Prunus persica*) and their role in split-pit formation. 2007. *Tree Physiol* 27: 649-59.

Vrebalov, J., Pan, I. L., Arroyo, A. J. M., McQuinn, R., Chung, M., Poole, M., Rose, J., Seymour, G., Grandillo, S., Giovannoni, J., and Irish, V. F. 2009. Fleshy fruit expansion and ripening are regulated by the tomato SHATTERPROOF gene TAGL1. *The Plant Cell* 21: 3041-3062.

Whitmore, T. C. 1973. The Palms of Malaya. Longmans, Malaysia, pp: 56-58.

The term "a" or "an" is intended to mean "one or more." The term "comprise" and variations thereof such as "comprises" and "comprising," when preceding the recitation of a step or an element, are intended to mean that the addition of further steps or elements is optional and not excluded. All patents, patent applications, and other published reference materials cited in this specification are hereby incorporated herein by reference in their entirety.

EXEMPLARY SEQUENCES

```
SEQ ID NO: 1-8217

SNPs in Table A

SEQ ID NO: 8218

~3.4 MB sequence of genetic region comprising the SHELL gene

SEQ ID NO: 8219 - SHELL locus

GTGAAGTTTAGATACTACCTGGGTAGCACTATCATCAAGCTGCCATGCATTGCACTCATT

TTAAATTGAGATGACTCAAATGAGTGCTATGTGTCTCCAAAATTATAGATTTACAACTAT

TAATTAATGTTTTTAAATTTTAACAAATACGTGCCAACAATCAAAGTAACACATGTCCAA

TGGGAGTATTTGGACAGGGGTTAGCATCATCTGGCTGCCTGCATGTAAGTCAATATGTAT

TTAATTTCTAACTATGAACAACTTAATAGACTCAATTGTTATGGTTTTCGTGGCAAAGCT

GCAGACGACATGGGCAGACATTATTTTTGCTAGACTAAAGAGCAGAGAGACGATTGACGG

GGATTCCATCATGGTGGTAGCCTGATTACATAAACAATTATCATCAGCAGCAGCGCATCT

TCTCATTCATGATAGTCAGTGTCAGGGAGCTGCTTTTCTATTGAGATTCGTTATATTTAT

CGAGAGGTCAATAGCTCTACTGACTGGATGATCTTTTATGTGACTGAGCATATCGGAGAG

ACGGTGTGGACTAAGATCAAAGATCTTCCTTCGACCTTCAAGAATATTTATTTTTTAATT

TTTTTtGGATGTATTCGTATGAATAATCTAGCCTATCAAAAAAaTAAAGTGACATGTGG

CCTGGCACAAAGTCACGTGACCTTGAATTCCAACAAGCATTTTAGATTATAAGCTTACAC

CATGGGCGAGGGAAGTTTTCCACATTTTCTTGCTACTTCTAGACGCTTGGCATACACTTA

CATGTCTAACCAAATCTCATAGTAACAGCAAATTGCTTGAAATACAGATTGCTCTATGTC

AAATTCTTTAGGCTGCAGTGAGAAAGGAGATAGGCGAAACTGAAGAAGGGTGGAAAATC
```

-continued

```
TAAAGTTCCATACCACCAGTTCATGCAAACATCACTGGTTGGTCAGCTGACCTCTAACAA
GAAAGACTATTCACATGGAGGGATGACCCACTGATGCCCCAAAACAATAATGCAAACAAA
GAGAGGGTCGCTCTCTCACTTGAGCAGCGTAGGGATGCCAGTGAGTGCAATAAAGAAGTG
GGGACGAGGTATTAGAATTTCGATACATGTGTGCGTGTGTGAGTATCACAGAGAGAGAGA
GAGAGAGAGAGAGAGAGAGAGAGATTGCATGAAAGTCCTCAGAGTATGGGACATCTCCAAAA
CCAAGTCCAATATCTAGTGATGGGCTCTTTTATACAAAGAGTGATGCGCAAGAAATAGAA
GACATGGAGGTGAGAAGCTTGATCCATGCATGCATGAACATGATGTGAGAGAGACCATGA
AGCTGAAGAAAGGTCCATAGCCACAGAGGCAATAAAAGAACATGGTTGGGATGTTAAATC
ACAGTAAATGGTGAAAAGAACATGGTGCAACTATAAGGGGAACTAGTTTTAGTAGTTCAT
CTTTTTAGGACCACACCGCAAGGTGGACAGTTGGTGTTACATTTAGTCTCTCTTCATTCT
CTTTTAAGGGAAAATGTCATCTAGAGTTTGCAGAAGTTTTGAAGTTTTACAATATCGCTT
AATTTAATTCAATTGATGAACAATAATATTTAGTGATTGAAGGTGTGAACTGTAAGGTCA
CTTGAAATTTAGAGTCTATACACATTGGGAGTTCAAAATATCTGGTCAATTTTATTAAAA
TGTATTGTTCCAATATTAAAATTTTCTCGAGTTTTCTTTAAAGGACTCTAGTGTTCCTTT
GATCTAAAAACAGTCTAATTTTTTGCTACCACAAATATACTACAGTAGAGGCAAAAAAAT
CTAGATAACACAAAGGAACAAACAACTTTATGTTTTTAAGCAAGCAAATAAGTACATATT
CTTCCAACGTTTTCTCCAAGAACATGATCAATAGTTCAAAATGTTTGTCCCTTGATATTC
TTTACAGAAAAAACTCACGGACAATAAGCTTAAATCTTCATGGCCAGTATATTTTGTAAT
ATATGGTGAAACTGGAGTTCAGTTGTTCTACAATCCTAATAAGATCATAGGGGTGCAATT
CTTGTGTCCTTACACTTAGGGAAAAAGCTTTATGCCCCAGCTAGAAAGATTATATCGATG
GTCCCGGAGGAGTCTTGATTTAGTACATAACTTCTAAATGTGGAGCATCGCCCAGGAAGG
AAATATATCCATATTAACAAAGTTTGCAACATTTGGATTGGATGATAGTCCAATGAAGAA
AAATTGACCTACTCAACCATGACAATGGAGCTGTCCTCCTAACATGATAAGGACATAGCA
ACCATACTTTGGTGACATTTTAAAATCATGCAATTACTTCATCATGTTTACCATGGAAAA
TTACACAAGAAGATGGAAAACATAGCATAGCATTTACCATAAAGAACCATGCATCGTTAC
GTCATCCAAGCGATTCAGGTGCATGCATGTAGATTTTCCTCTCTTTGATCTATATATATA
TATATATATATATATATATATATaTATAtATaNNNNNNNNNNNNNNNNNNNNNNNNNNNN
NNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNNNNNNNNNNNNNNNNNNNNNNNNNN
NNNNNNNNNNNNNNNNNNNNNNNNNNNNNNNNNNNATATATATATATATATATATATATAT
ATATATATATCTAACTTAATAACGAAGTCTTATGTATGCTAaGTTTTCCCTTTAGAATAC
TTGGAAGGCTTGACAGCATGCAATCATTCAATCAAAACAAGAGAGATAATAGATTGTTTC
AGAGCTAGGCTTTTGGAACAAGTAAATATAGTAATACAAATAGACAATACAAAAGACAAC
ATTTTTGTTTCCAGAAAACCATTATAGAATTTTCTAAGCCTTTCCCTTCTAATGAGGAAC
ATGTTCATTGCAATGTTAGAGCTATATGACTAACTTGTATAACGGACATGCCACGTTAGC
CTTGAGTGATCTTGAAATTGTTGAATTAGTCCAACAAATACGACTATTTGCTGACGCCTA
GCCCAAATAAAACAGAATTAACATGCAGTCTAGTCTGAATTAGTGGCTTCCACTAAGGAT
TAGAATGTTTCTCCTAACTATAGAGCAAGAAGACCTCTTGTATTTAGCAATGTTATCCAA
GCTGGTCGTTATTATTCCTCTAGAATTGGCTCCCACTGATCAGCTACCAAAGTTAGTCCA
CAGCACATAGTCCCAAACATGTCATTAGGTTTACCATAAATTTAGTATTTCTTGGTAAAT
```

```
AGAGGCAAACTTGCTGACTGTTCATGCAATTAAGTTACCTTGACATATGTGATGCATTAA

TTACATGCAAAGAAACCATCTATCATTTGGAGCTTATACTGGAAATTGAATTTCCCGAGA

GAATCTATATATTCATATTCGTTCATCCCTCGATTGTATTTTCAAGAAAAGATTTGAATT

TTAGGCAACATACCTTTTTCTCTATTGGTCTTAATTTTTTACATTTCCAACTACTTAATG

ATATGATTCAGATACATAGGGTTTCTACCCATTTTTCTTGAAAAGAAAaGAAGGAAAGGA

AAATCCAATAGAATTTACAGTGCATTGTTGAATCTGCCTAATCTGAACCATGACTTTAAA

AaAAAaAaaAaaGAAGAAGAAGAAGTTTCTGGCTACATTTTTATATCAGCTTATAATTAGT

TTTTATTAATAGTACTCACCAGGAAAAGTGTAAATATTAATTGTTCTTATGTATTATTGC

TTTTCTTAGTGTTTTTCTGTTAGGAAAACAAAAGAAACTTGAAATTGCACTAACTACAAG

TATAAAAATGAAAAAAGGTAAGGCCAATGTTAGAGAGCACTAAGGCTTCATGGTATAACC

TTCAAAAGTTGTGATGGATACAATACCATAGGTATTTGTTCTTGCTAGCCATAAAAATAT

ACAAGCATATGAGGGTAGCACATGGTAAGTAGACACAAGGTATATTTATCTTCATGATAT

CACTACAATAACCTGATGATATGGTGATGATGTTATCCATAACCTTATCAATAATTTGGT

TTTGATTTTCTACAAACAGGGATGTGTTTTtATTCTTTTtGAaTAtATATATATATATAT

ATATATATATATATATAAaGAAAAAAaaCCTTGGCACCGGTAGGGCATCATGTTAATTAA

CAGACATGATAATGTAGTACTAAAAGCTACATCTAATATAATTGTACTTTTACTAACTTG

ATGTGAAACTTAAAATTGTATTGCTTGGGATCACCACTTTATGTTGCACCACTTTTGTGT

GTTCTTGAGCATATCTGCGCATATCCTCTTTCACTCGCATTATTTAGATATTAAGTGCAA

ACATTTAAGAACCAGTTATCCTTGAAAGACATTTGAGACTGCATGAATGCCATCAGATTT

CTTGGCCAATGGAATGAAGCAGGAATGGATGTAATGTGATGTACGTGGGTAGAAGGGACA

GCGTTAACATGAAACATGTGGAAGTTTTAATATTTTGAGAAGAGATACATGCAAGTTACA

AAAAAaTTAAAAAaGAACATACAAAAAAAAaCTATTTATAGATGAAAGAAATGAAAAGA

AAGAAAAaCTTTAAAAGAAaGAAAAAAAaCTTTAAAATACACCGCAACGATTAATTTCTT

ATTCACCATGTCACCTCTTCTATGAATAACGAATCAAGAAAAGATCTGTGGCAGGTATTG

CCAAGCCAAGCTTCAATAAGGTTTTGTTACTTCTAGAATCCAAACTCCCTTGACCTCATA

GTTATGCGAGAGTCTAGTCTATTCATTACTTAATTCCCCCACCTAACCCTAATCTGAGAA

GGAATTATTATGGCTTGGGGAGATCACGTGCGGAGGAGGCGCCACCGATCGTTTTCACTT

TACCGCGCGCTTTTCAGTCCTAGCAGTGCCCCCCCAGTCCCCACCACTTCCCTGTCAACT

GCTCCACCGCAACCTCTCAATCTCCTAACAATCACTCCAATAACGACAAAATGATGGAGC

TAACCCATGACATTTTATATCGAAGATATAGTAGCACAAACTCCATCCGGCGGTACAGCT

TACCCAGCCAACCCACCCTCCACTCTTTAAGAGGAAACCCACATATCCGATGCCAATTGC

ATGCAGTGGAAAGAGAGAGAGAGAGAGCGCTGAGCTCCCTTCTTTTCCCTCGGAATTT

GCGGTGTTGGACTTCACCTTCTCTTCCGGCGTGGAAGCTGAGTTCCCGGAGTGGTAGTTT

TTTCCTTTTtTTTTTTTttGAGAACAATTTCTGTCTTTCTTTCTTTGTTGTTTCGG

CTtTTTtGATATTTGTTTCCTTTCTTGAGGAATAGTTTTTATGATAATACCGGAATTGGG

GGTTGCTAGAAATCGTGAGGTGTCATTGTTATAGGTTTTTTTTTTtGCTGGATCTTCGG

CGATCTTTTGCTGATATTATCCGTTTTTAACGATCGGAACGTTGGTTGCGTCACCAACA

AAATGCGACTTTGTTCTCGCTTCTCGCTAGATTTGCTCCACGAAAACAGTAGCTTTGTCG

GATCGGATCGTTTGCTCCATGTCTAGTTTTTAGGGTTATCTTTTCACATGTTCTTGAATA

TATCTTTGTCAAGaaaAAaaAAAAAAaCTTTaCCTTTTGTTCTATAACAAAAATCTTTTC

TTCCACGTATTTTGGTTGCCCTAGTTtTTtCTTTTTTTtGTTTGTTTGTATTTGTTAGAG
```

-continued

```
AATCGAGATTTGAGCCGTACATCTCGTTCATAAACTGTTTCATTTGTCAGAATTTAAAGA

AACTAAACTTCACGTATGCATCGTTATCCATTTGTCATGATCTTGTCTCATGAATATATG

TATTCTGTTCTTGTCTTCGCCTTAATTtTTTTCTCACTTTCTTTTCCGAACCCTAACCCA

TTCAAAGTTCCCACCTTTTCTCTCTTACTTGCTTTCATGTTTTTTtCCTTTTttTTTTtG

TTGCTTTTAATTTTGCTTGAATACCTTTTGATCTATGGAAATTAATAAGTCAATATGTCA

GTATGTGAAGGTCTAGGCCATGTTAGTCCCATCATTTCATTTATAGTTTAGATGATGATT

TtTTCTTTGTTCTTGGCAATATTCTAGACCAACTTCAGCAGACAGAGGTGAAAGAGAGAT

CATGGGTAGAGGAAAGATTGAGATCAAGAGGATCGAGAACACCACAAGCCGGCAGGTCAC

TTTCTGCAAACGCCGAAATGGACTGCTGAAGAATGCTTATGAGTTGTCTGTCCTTTGTGA

TGCTGAGGTTGCCCTTATTGTCTTCTCCAGCCGGGGCCGCCTCTATGAGTACGCCAATAA

CAGGTATGCTTTGATGACGCCTTCTCTTCCTTCGCTCATATCAAGTTAATTTTATGGCTT

CATTTGTTCTATGGCCAAGCCAAATTCTTTTTAAAGTTCTAGAATGTTAATGATGGTAGT

TTTGCTCCTCTTCAATTTATTTGCTTCCCTTTTATCCCTGATCCAAATGGTTTtTTTCTT

ATTTAAAATTACCCTTTCAAATTATCACATTTAATTCAGCTTTTATTATTATTATTATTG

CTATGAGATTAGTTTGTTGTTAAGATTCTATATAGGAAGGAATGATCAAGTGATCATTAC

TTTATGTAGTAAGAAATTAACAAGCAAAAGCAGCGTGCTTGGTCTTACCATGAGGATAGA

GGAAGAGTTTTACCTTGACTAGGGCAACTAAAAAGGGTTTGAGTTTTGCCTAACATTCTT

GTTATATGAATTCGATCTGTACACGACTTACTACTCTGGTATTAGAACGTATGTACTAAG

AAGTTTTCTTGGGATGGAAAGAAAGAAATAGTGAAGTAAATCTTATTAATTTGTCTTTAC

ATGTTCTTCTCATATTTTCTCATACTCTTTTCTTATGTTCAGACTTACACCGAAAAATTA

AGATGGATGATATTATGTTCTTGGTATAGGATTTCTTTTCCGACGTACCAATGTTTTGTT

AAGGAAACTTTGTAGTTGACTTTTCGATTATAATATTTTCCAAAGGACTCCACGAAATGG

TAACATCTCCAGTCGTTTCAATAAACTTCCGATCATATTATGGGTTTGCATTTAAGGTTT

TCTTCTTCCCTTCGCTTCCTCTTTGCCTTTGCCTTTCTCGTGTTACACTTCTGGCTCGTC

AATCTGCAGTACTCTCTAGCCATCTCTCTCTCTCTCCATCCACccaccCCCCCCCcCCCc

AAaCAACACACACACCCTCCCACCCTGTGCAACTAATTCCGACAAAATAAGGGTCTCCCA

TTGTTAGAGCACCTCCTGTATGGACTGCATTCTAAAGATACGGGAAAATGAGCCAGATAT

CTATTCATCAATCATTTAGTAGAGTCTCTAAGGTTCCTTTTTAAAACTGTCTTGAACCGG

CTTTTGCACAAAGAGCACCACTCCCTTTATTTATAAGTTGAACCTTCCTGAAAGCTAACT

TGGGTTTCAGCTTTCACTGTTCAAGTAAGTCATAAAGTTTTTCTGGTCATTAAACCTTGT

GATATGGAGATGGAAACTGCTTTTCTCCCTGCCGGATTTCTCTTCTGGTGCTAAGCGGCT

AAAACCCATCATCCATGTCTGCCTTCCTCTTTTATGGGTAGTTGCTGGACTTCGGACACC

GGTGAAGGATGAAGGCTCTTTGTGATTGGTTATGAGATATTTCTTGGGCCCCGTGCCTTT

GCTGTCATTCCCCACAACTCGGTGGCCATCATAGCTTTTTTGTTAGCTTTCGTCCTTACA

AATTCCTCTCTGGTTCTTTCTTTCACCTTTTCATGCATTTAGCTTCATTGTCAACATCAA

GGGAACACAGACCGGAAGAAGAGCAAGAAGAACCCAATCAAGACTGGATTTTACAAATCA

CCAAaAAAAAAAAaGACTGGATTTTACTCGACGACGCTGCAGTCTTCTCTGCTCTCACT

CAATTAAAATAGGAACAAGGAAAATGTAGATATTTTTtCCCTtTTCGTTATGATAATTAT

AATCTAAGAAAGATTTTAAAAGCTTACTGTAATCATCTCATGTTCAACTATTGTGTTGCA

CCCAACGAAATTTCTGTGTGCCTCATGACGAGCATTACCTTTCCATGGTTCTGACACGAC
```

-continued
ATTGCATACTAGATTTTACTGTGTACGTAAAAAAGCACTGCATGACATCATCTCTATTCT

TCTTCTTCATtCCCttTtTTTtTTTTTTtGGTAATATCTATTCTTCTTTAATGTCCTCTC

TGATAACTGGTCTTATGTACAGGTACATCTTTACAAGCCTTCCGAGAGAATATGAATGCG

TATTTTCTGCAACCGAGTATATTCTACAAATAAAATGTTAGAGATTGTCTCGAACTGGTA

TACAAGCACATTCCTGTACGTGTTGACATGAAAGAAGCATAGATCAGACAAAATAATAG

TACGTGACAAAGATCATAAAGGGACTACAACATTAGGAGGGCTACAATTAATAATAACAA

CGGGAGCAACTAGCAGTGTATACGGTTCAGACCAGATCAGTTTAGAGTTATTTTGGAAC

CGAGCTGACTTAGTTGTTTTTCTAAAGCCTAAATTGAAAGAGAAACCGATTCAACCTGAT

CCGAAATACTCGATTTGGTTTCATTCAGTTTATTTGGGTTGATGTTCCATAGTTTGGGCT

ACATTGATTGCACTAAGTCTAAATATAAAAATTTCATTTTATATAGAATTGATGTTCAAT

GGACCGGACTAAGTTTAAACATATAAAAATATTTAAATTTTGAAATATATATGTACATAT

ACACATGTAGGTCGGGTAGGTTTAAATATAGATACTTACATATAAATGGATTGGGTCTGG

TTGGGTCAATGCGAGTCTGCTTAAATATATATATACATATGGGCTAGGTCAAATCAGGTT

AGTTTATATATATATATATATGTGTATGTGTGTATCGGATTTGTTGGTTTGCACTG

ATTTTCTAAAAAaTAAAATCGAAATCGAATCAAATTTTTTCTGTTCAAGAGTATCTCAAA

CTAATTTTTAaAAAAAAAAaTGATATAACTAGATCAAAAAAGACCGATTTGAATAGGCAC

TTTATGATTTTGTCACTTTTTTGTATACCTCTACGAGCAACAATAATAGAAACAATAATA

ACAATTGTAATAATCAATATAAAAATTATTAATAGTAATTAaAAAATATATACAAAATTT

TTGCAAGCATTCAAGTGGACACAAATCAAAGGGCACTAATGCATTCATAAAAGGTTGCTA

GCTTTGATCCATGGTAGCATCGTGTATCCTGAATCATTTGTAGGTTAATTGAAACCTCCT

AAATTGCATTTTAAATAAAAATAGCATGCATTTTATGAAGATAACCTTACTATTATTAGG

TAATAAGGTTGTTAAATTCTAACCTAATTAATATCTCCTAATTAAGAGATAATAGTTGTG

GTGGAAACGAGATGGAGAGAAAGCACTTCATCTCTCATCTTTCCTCTCTAAATAACATTT

CACTAAGAGATTTAATTATTGGATCAAGGCTAGCCAGTTTGTTATCTtTTTTTGTTCTAG

AAGTGTTGACCTTTTACCATTTCTCATATGAAAAAAAaCATTATCTAAGAAGAATAAATT

ATTATGATCATGAGGAGAGAGAAGGGGTGTTAAGGTTATTGGATTAAAATCAAACTGATT

AGAGGACCTTGTTTGCTATTATAAACCCATGACAACAATCAATATGCACTAAAGTTTTGG

TATAATAAGTTATCATCAAGGGCCAAAAAGGATTAACTCGAGAACACAAGCATACAATTT

AACATCGTACATAGATAAATTCAATTTAGGAGGTAATTATTGATGTATATGCTTAGACAA

GAAGAAAGTATAGAAAGTAAGGAAAATTGCTTGAATGATTTAGAAGTGCATAAATATAAT

CTAAATTTGAGGAGTCTTATTTATATTTTGAGAATTAGAAAGGGGAGAAAATTGAACAA

AACTTTGATAAATTGATTGTAAGAATTTTCAAACCTTAAAGCGAAAGTGATAGTGAAGTG

GAACCATTAACCATAATTTGATATTAAAAGGTTATCTATATTCATTAATATCATtTTTTT

AAATTATTGTATATATTTTTTGGGAGGAAAATTATGTTCTTTAAAAGTTAGATTGGTTTC

GTACTTATCATAAATGATAAATGATCTGAATTTAGTTTGAAAATTATTTGACATATAACC

TTTGATAAGAAATTACATATTAGGATTTTATGGTTTACTGTCATATAGTTCTTTGTTTTG

TATTTATTTAACTTTGACCATAAATGATTTGAAGTCAAGATACTTTAATTCTAGCCTCCC

CATCAACATGTTGATGGCTTATGATTTTtATTTTTtATAACATTTATTTTTATCTATAAT

ATTTTTCATTATTAATTTAATGAAAGTGGATTACACGACATCTAACTTATATTTTTGAAA

ATAGAGAATGATATGGTATACTATTTTGAACATGTTCAGAAATTAGAATCTTATTATTGT

TTTCATAAATTTAAAATATTATACTTGTCAATATGAAACATATTAAAAATGATCTAAAAT

-continued

ATtTTTTAAAATTTAAATGTCATAGGTTTGAAAAATTCTTACTTGTAAATATATGATTTG

TAACTAAATATTTTTAATGGCATGATATTATTTTCTAATTCCATCAAAGATCTAGAACCT

TTCAAATTAGTTGAACTTAGATACGTGTTTTAATATGTCTTAATCAAGATCAACAATTTG

ACTTCTTATTTTATATGATATATGGTATATTCTCACTTGATGCATCTGTAAGAAAATTTA

AAATTCTTTTATTTTATTTTATATATGTGTCAATACTATAATTCTTGATTATATGGATTT

CTAGTACACTTAGATTGTGATTGTTGTTTGGCATTGGAAGATCGAGACAATTAATACCAT

AAGTGGGATATATACTTGCTTAACCCAACATTAAACCAAAATCACCTCTCGACAATCACA

CAAGGACAAGTGTACTCAAGATAAACATGGATTGTCAAGATATATATAAGAATAATAAAT

CATGTATATAATTTtTTTTCATCTACAAACTTCTCTTCTTTCTCTTAATTTAGTATATAA

CTTCCATACCAATAGATTACtTTTTATTTGACCCAAAAATCAATTTAACCTTTTGTTTTt

AATTTAATCCTTTGTCTTCTTAAATGACTCAGCTTGTAATTTAAATATATCATTACTTAT

GCAGTAATGTCCATTTGTTGTAAATAAATATTTGGCAATAGAAGAAATACTATAAGGTCA

AAAAATATAAACAGGACAATGAAGCATTTCGTATAGTCTATTATAAATGTAGAATGAAAC

ATAATAGGCTTTTCATTTGATCTATAATTAAATATAATTATCAAATATCAAAATTAATGT

ACCAATTTATGAGACATCAATATTATAAAGGGATACTAAGAAACTAACGAGAGTACACTG

ATCAAGAAATGTGATCGACCAGTGAGGCATGTTGTTTATAAATTAATTAGACACGTTTTC

AATTTATGAGAATTTGTATTCAAATATTTATAATTGATAAATGGATCACTTTTTATTTGC

TCTTTATATTTAGACTCCAAATAGTGCTGTAAGAGAaAAAAATTTGAAAAAaTAATTTAT

ATTTTCAaAAAAAATATTTTTATCAATTTTCATTACCATAAAaAAAGATCGAAAATAAAA

TTAAGAAAGAATGAGATAAGTTTGATAATTTTAGACATCCGCTTGCATAATAGTTCATGT

TTAATATTAATTTATCACTGAGAATGCAAAAATATATAAAATTTTTAATTAAGCTTTGCT

ACATATAATTATTATATATCACTTACATAAATGATTTGATTAAATATTTTTAAAATTTTA

ATCTAATTTTTAATTGCATAGATATCTATTGCAGTAATTTTCCTCTAAATAATAAATTAA

ACTAAGAAAATAAAAAATATTTAATAACAATTGGAATATACTTATCAATCCTATAAGAAT

AATTCCTGTAAAACTCCATCCATTTAACTTGCATCATGCATCATTTATTTTTTTATTTTt

AATCATTTAGAAATTTAAAATCAAAATTCAACTTTTATAGATTTATTAGAATGCATGGAA

TGATTTCATAAATGTTGCATTGTACTAAAAGAATTTATGATAATCTATACAAGTCAAGCA

TTTAAATTACTTATTATACTTTACAATAGTAAACTACCTTTTGAGCAAAATGGTGGTAAC

CCATCATAATATGTCATATGATAAATAAAATGAAGTACAAGGCTAGATAAAGAAGGGGGA

CAGAAAGAGAGATATAGGGCTCCCGAGCTTAAGCAACCAAGCAATTCAATATAGTTGCAA

CCAATAAAATCCGATATGAGCAAATATAAATATAACTCACTAAAAGCCCAAAATACACCC

AATAAGCCCAGGTAACCACTAGCCCAAACATAATGGCCTACTAAGTTTGAATTTTAAAGT

TTAAGTCTTTGCCCATTCACCACCTCTACCTTCCAAGCTCTAATTATTTTAATGCCATTG

CAAATCATCATGTCTTCTCTTCTTCTAATTTGGTGTACTATCATTTTCAATGTATTGCAA

CTCTATTGCCAATCGATGCTCCTCCAAGGCATCTCTCAAGATCTCATTTGGCTCTATTGC

GCTACCACTACCATCCATCCTATTACTCTCTAGATCAATATCAAAATTAATGCAGCTCTT

TTCTCGATACTTTTTGCATCATCATCTCACTCCATCATCACAGTCTATACTTGTTATTTG

GAGCCTATGCTTGCTACTATATTGTGACCTCAATATTACAATCTCTACTTGTTACCACTC

AATGTCCATGCCCATCTTCCATGAAAGCTACTTGGCAAACAATCCTAATAGGTTCCAAAA

AACCCCACAGCTAAGGACTAAACACACAACCACACAGGTTCTCTTATACTCTCTTTATTT

-continued

```
AGATTCAAATCTACATACTAGGCTAAGAGTCCAATTCTAGTCAAACTGAATCATAAACAT

CATAATCAATCCATGGTCAACTCCAACCATTTATGAAGCATAAGATCTTATCTAAAAAAA aTCAACCAAAAGTTATTATTTGGCTTCCTTATCCCTATATAAGTATCTAAATATCCTTTG

TGTACAACCAATATCAAATAAAATACATGCTTGTGCGGAGATCCTCACAAAAATATTTAG

CAAAATAATCCTATCAATGTTGTTAGGATTGATGTTGAGTCATAAATCATATATATAGTG

GATTGGATTAGATTCATCATCGATCGAATTATAGATCATTAGATCTTTTTGAATTATTTA

AGATTTTTAAAATATACAAGAAATGCAAAAATTAAAAGTATAAGATGAATATAGAATTGA

TGAATAAAGAACCAAAAAATATACTGAACTAAAAGAGAGAGTATGTTGGCTTAACCAATT

GTAGCAAGGTAGAAACCCCACTATGGTATGTATAACATAAGAAAGACCGTTATTAAAGA

GAAACAGATGCAAATCACTTTATTCTAAGATTAAAAATACTATCTTAGCTAGCTACTTTA

AGGATACAACTTTTACACATTCACTCACAAATCCTAGAGATTTAGCAAAAGAGAAAAGAG

AGAAAAAAGAGGAAAGGCAAGGGAAGAATAGTTCCTATAATAGAATTTTCACTAGTTAAT

AACTCAAGTATCTCTAGGATGACTACAAGAGTAGCTCCAATAGGATATTTGTAGGTAATA

TATAGGAACTCAATTCTTAAACTTTTCAATGTGGGATTCCAAATTTCATTCTAACTCCAA

TAATTGTAATGCAAATTTTTCTAACAACATCAAAAGTTATTAACAATAAACTCATAACAA

TTAAAACTTTTCAAAATTTATTAATATCAAACTCTCCTAACTTAGACAAAAAATGGATAG

AAAAATAAGTAATCATAAAAAAaCTAGTTGACCCAAGTTTATAGGATTTGAGACCTATGT

AGCCTAAACCTATAACCCATGTGGTTAGAACCCACGATCTATGTTGTTAGGACTTGCAAC

CCGCTCTAGCATCACATACATTTAAGAAATCTAATTTGCTTCCTTATAAGTTCATATATA

TGGAATGTCTAATAAACAAATATTGTGCCTGATTATTCAAGATCTATATTTGTACCATCT

GCCAATTAATTATCATTTTATTTAGAATGTGGTTAAAAAATATAAAAATTTCTCTTTTAA

GTCCATAAACTCCAATACTATATTAGTTACCTTACTAACCAAGATCTAGAAATAATTTAA

AATCTATAAAATTTAATGAATTATAGAAATTGGACTACATAATCCATAATATGACATTAA

ATTCTAATTTCTTAATAGATAATGATTCAAAGATAAGGTCCGGATTGTTTATGGCCATTT

TATCTAGATTGTAAGATGCATAACTTGAATGATAAGATTTTAACAACAATAGCTCCTATT

AAAAaTTAAAAAAaTATTTCTTATATAGTTATCATAAAAGGTGGTAATCAAGTCATATTA

TATTTATCAAAGCACTGTCTAAGCAATAGCTACATGATACTCTATAGTATCTAAGCACTA

TTCTCATTATCTTTATTTCTCTTTTTAAAATTTAGTGAGATGGTTGCATTGCCTCCATCT

ATGACTTAAATTTTTGGATAACAAAGCCATATCTATTAAGTTTCTTTAATGAACATATTT

TGGCTCAAGTCCATTAGGATAAAAATCTTTTAGAGAGCATGAAAATTATATGGTTAGAAA

ATGTTACTAAAGGTGATTTCATATGATTCTTAATGTCTAAAATAGTGTTTAACTTTCTTT

TCTCTATTTTTAGTAACCAATGTCAACAACCTTAATGAAGCACTTGAAAAGATCGTCTCC

TTAATAATTTATATTGTAAGTTTAAATTTTAGTTCCTTGAACTATTGATAACTAATTGTT

ACTTCAGTAACTCATCAAACTATTTTTAATAATTCTCTCCATGATTCTCTTACATGTCCT

TTTAAAATGCAACATGATATATCAATATGCTTTTCTATTAGACAATTCAACTTCTAATTA

TGAGTAATTAAATATATAATTTTTATTAAAATGGATCTAATTTTTTTGGTTTGGCAACT

CTTTTGTTCAGCATAAGATCAACAATTGATAGGTACAAGAAGGCATGTGCCAACAGTTCA

AACTCAGGTGCCACCATAGAGATTAATTCTCAAGTAAGAAAGACATGGCAATTTAATCTA

AAATAGATTTCTCTGAAGTCCATATATTTTTGCCTCATATGCTTATCAGTTAAAATTCTT

CATGCTCATAAAGGCATAAAAGCAAGTCAGTAAATTATTTGTACAGTTGATCTTTTTGTT

GTTTGTTCATAGCCTTACATGTATCTTTGAATATTTTGTTGATATATTGATTGCACAGAT
```

-continued

```
TTTTTTtCTTATTTCCATTGATTGTTGCTTTTCTTGGATATATTTGATAGGTTTGATTGA

GAATAGTGGATTAAGGTGGTTTACAACCTTTCTTTGAGAGTTGTAAGGGTGTAAAGGGCT

AGATCTACTAAGAGATGAGGGTGATGATACTACTAACTATTAAGACTATGTCGGAGTCCT

TTTTCTTATGGATAACATATATTTGAAGTTGTCATTCCTATAATGTAAGAGGTAATGAA

AAGATTTTTCTTGCAAATTAGAATCACTTTGCATCAACTCCAATACTTTTCTTTATGCTA

ATAAGGTAGTGAATTTTAGTGATATCGTCTAGGAATGATTCAACTAATACCTCATTGCTT

TTGAACCATAATTGCTTTTCCTCTATTTTCTTTTTTTtCATTTCAATCATATTTGTTATG

GTGTAGGAGGGAAGGTATCATTAATCCCATATTAGTTGTGAGTCAAGGAGGACTCTGAAG

GAACTACCCATCCTACATGAGGTGCTTTTTGGATTGAAATCCAAAGGGATAAAATTTTGA

GACCTATGAGCCAAAACGGACAATACGTAATAGCCGAGCCATGAGCTCTTGGTTGCAACA

GTGGCACACTAGGAAAGGAATCACCCTTATGACTGTGGGATCCCTCTCATCCGTACACAA

ACTCCTTGACTGGAGGGCGGTAATAAAATAAAGATGATGGTACCTTCCGTCTATCCATAG

ACTTCTTCTTGACTGGGGGCTATATTGTGGCGTAGGAAGGAGGGCATCATTAGTCCCACA

TTAATTATGAATTAAAAGGCTGGGACTCTAACTTATATAGGAAGGAAACACTCATCCTAC

ATAAGGTGTCTTTTGGATTGAAATTCAAAGAGACAATCATGAGGCCCATGGGCAAAAACG

GACAATACTTCACATGCCAAGCCATGAGCTCTTAATCATAATAGTGGAGGGAGGGCATCA

TTAGTCTCATATTGGTTGTAAATCAAAGAAGATCCTAGCTTATATGGGATGGGACCTTTT

CTTCTCTGTGACGCCCCATGCCATGTCAATCAAAGATCGAAGTGGATAATACCTCACATA

TACAAGAACGGAGATCAATCTACCCGAGCCATGAGCCCTTGACTGCAATATTGATGTGCC

AGATAAGGGACCTCCCCTACGACTGTGGGGCCTATCCCTCTGTACATAGACTCTTCCTTG

ATTATAGAGCTATATTATGGTGTAAGAGGGAGGACATCATTAATCTTACATAGGTTGTGA

GTTAAGAGAGACTCTGATTTATATGAAATGGAATCTTCTCTCCTCTGTGAGGTCCCATAT

CATAGTGGCTAAAGATCGAAACGAATAATACATCACATATGCGGGAGTGCAGACTGACCC

ATCTGAGCCATAGGCTAACAATATTATCATAGAATCATGATTTGTAGTGAGCATTCATCT

ACTATTTTTTTtCCAGAACTCATTTCAATTTATCTCAATTTTCATGTTTTAAAAGAAGGA

TAGATCTTGCCCAATAATACATATAATATTTATGAAAGTCCTATGAAAGCCTTATTGTAG

TCAGAAAACAAGGTCAAAAATACATTCTAGTCTATGGTTGAGAACTTCAACCAATTGACT

ACGTTGCCTGAATGTTCAAAAGAATTCAATAGTTCAATCAACAAATAGAGATGGGATCAT

ATCATCTTTTtATTTCATCAATTTTGCTGAATGATATCTATAATATATATGTGCCTTCGC

TCTAAAAATCTTTGGCCTAAGTTCAGATTTATGATAGCAACTCTTCAAAAAaCCAAAAaT

TGTGATGACAACTGTTGCCTAGGCGACATGTAAGTGGTTAAGATTGAAAACTCTAAAATA

GAGTGCAGCTACTCTAGGTAAAAGATCACTGACATAGACATACATCAAAGTTCGTCTGCT

CCTTAATTATTTCTTTTACTAAAGTAGATGTTGAATCATAGGCGAACAATACTACTGAAC

AATACATATTTCTTGCATACATTGGCTTGACTATTAGTGCTATGCACTCTAGGTTCATTT

ATACTTCACAAGAGTTTTTATTTGTTTGCCAACATCAAATTTCATGCAATCAAAAACACA

ACTTGCAGAAAAAATGAATAAGAGTTAAGTAAAAGGACCTAATTATCATAAGCTATGGAA

GACAAGACAAGGGATACTGCCATTGATACTCTTAGTAAAATAGTGTTATAAGTGATAGTA

ATAGCAATATGAAGAAAGTATGAAAGAACTAGTTTTTTCTTAAAAGAGTATGAAATGCA

TACAAGTTGCGGTATCATTTGTGAAAGAGAAAGTATTTTCTTTTATTTACGTTTAGTCAA

AACCATATTTATTTGTTATAGCTGATCCCTGAAATTTCATAACTCACACCAATTGGCATG
```

```
ATGTTATTAGCTTAGATTTGCCATTATACCGCCATTGGTAAGAACAAAATGCCCTCAATA

CCAAAATAAACTGCATTTGCAAGTTATTTGAAAGAAGTGCAACTCTATTATTGTGGCATG

TTAACGAGCTTTTCTATAATTTGAATTTTTTGTACCGTCTATGATGGTTATCAAATTGTA

TAACGAAGGCAAAAAACTATGGCTAAATGATTCGTTTTTATGAATTATTGTATGCTACTC

ATGCTATACTTTGTTTGTTTCATCATGATCATTACCTGCAAATCATCTACTCGCATGATA

CAGCTACGCATTTGTCACATTCCGAACCTAGCATCTGGGTCAGCCATGCGATGGCCTCAT

ATTCCCTAAGGCAAGGCTCTAAAGAATATACAAAGTCTTAACTTCTTTACATCCTCAAAA

TCACATGAGCACTATTGATATCAATTTAAAATAAATATTTTTAATTAATAAATACCAAAC

TTTATACAATTTATAGAACTCAAGTATCTGATTGGTGTTGATAATGCTCCATCTAATTAA

TTCCTTCAATCTTGATCTCAACTATAACCAAAATACATATATCCTATGACTCTTAAAAA

GAAAaGGAAAAGAGGAGATGTAAGCTTTACAATCCAATAAGAATTTTCACACACCAACAC

TAATATAATAATAATAAATAAaAAATAAGTAATAGTTGTTACTCTTATAAGTCTTCTGTC

ACAAGATACCATAATAATAAAACATGCAAAGAAAGTACATCTTTTTATATAATAAATCAT

ATTAAATACTTTTCTCAATTTATAGTTACTGGATTCGATAATATTTAGGTACTCGACACT

GAACTATCACAATCATGTTTCTGGCTCATGGCAAGATATCGACATAGTGGCTAGTCTCCT

AAACTATCACAATCATATTTTTGATCAGTGGTAGGATATCAACATGATGGCTAATCTAGA

GGGCCATATGTGCTTAACTCTGACTACTACAGCTAGATTTTCAATCTATGATCAGACACT

AATAAAGTAGCTTATCTAAAGGATTATAAGTGCTCAATTCTAAACTATCATAATCACATT

TTCAGATTACGGTAAGGATCAATATAGTGGCTTATCACACGACTACCACAACTATATTT

CCAGCTTGTGGTGGGGCATCAACAATATTAATAGCCTAAAGCACCACAACCCACTATTCA

GTTACACAATTCAATTAACAATTCAAGATCATACTCTTTTGTAAAATTCAATACACAAGA

TTATCGAAACTACTCAAGTTAGGATTAGTGATATATGATACATAACTTCATACAGATCTC

TCTCTATATATATGTATGTATATGTATGTGTTTGTATACATACAATTAACAAATAA

GCACATAGCATGCAACTATCAAAAATCATATAAATCAAAATCACTATGCACAAAATAATT

GTTATATAAATAGATGATCAATGTCTAGAAATTTTTCGCTCTACGTACTGATGACAAACT

TGGTTATAACTATTTATTAGTCCATGCCTAGCATGTCCAATCAATCAATATAATTTCAGT

TCATCCTGAATCAACCATTAGCATAAAAATTAAATAACTTATTGCCAGTGTTTTAATTTC

AAAGCTCTAATATTCGAATTAATCTTACTTTTAATTTCTCTATACTTTCTAATTAAAAAT

TACATAATTAAATAAAAAATTTGGATTTTATCTTGACTATAAACTAGAGCATAAAATCCC

TTGCTCAGTATTTCTTAATTGGATGATTGGTCCCATCCAAAATCAAAATCAATAATTAGA

AAGAGCCATAAAATGGTTATCATCGATGGTAGAAAATTTAGAAGAAGAATATAGCTAGTC

GAATAATAGCATCTGGCAACCTAAGTGGGTCAGGTCTGGCTGATTTAGCTGGTTATTCAT

GAATACAACAAAGATCATCTATGATAGATTTTGAGGTTGCTTGATCAAGACCAAGGTGGA

GAAAGGCAATGCTAGTAGCATCCAGTGACTAGTGTTAGCCCAATATACATAATCCAAATG

ATTAGTCTACAAATCAAAAGCCAAATTATAGCTCAATAGGAATTTGGTGATGATAAAATC

AAACAATGCTTAGCAGGGTCGGGTTTGGAGTTAACTATTATACAGAACAAGTCCAAAACC

TTCTTCTAGGATCAACATAGGGTCTACTATCAAGTCTTCAAAATCCATCTTTTTTtCTtC

TTTTTtATCCCTAAATATAAGAAGAGAGAGAAAAAGATAGAGGAAGAAAGCTGGTAGAAA

GAGATGTGAGAGAGAAGGGAGAAAAAaaGAACAAACCAAATCTCTCTCTTTCTCTCTTCA

TTATCTTCTTTCTTCAAAAAGGGGATTTTCCCCTTTCTCCCTCTCTTTCTCCTAGCGGAT

GGCTAAGGCCAGCAGTCTATGGTGGTGTCTAGTGGTGAAGATGCGATGGCCGCAGTGCTA
```

-continued

```
CAGCGATGGCAGTTGTCGGTTGGTAGTGGTAGTGGGCGATCCAATAGAAAGAAAAGGAAA

TCAAAACAAAATAGAAAAAGAAGCCTTGCTTTGATATGATAAGAAGACTACAAGGTGGTC

AGCGGTAATGACAAGCATCCGCATTAGCTTAACCTCTTATGATAGTTGCAAAGGCAATAA

TAGCCACAGTGGCTGACGGTGGATAAACTAAAGAAAACAGAAGGTCCTTAGTGCGGCAAC

ATCCGACGGTCTTCCAAGAAGATTTCAGCCAATGATGGCTGTATGAAAATAaAAAaGAAa

AAAaGGTACCAATAAGATGGGAGGCCACGATGCCTCGATCATCTCTAATGATGGCGTGAC

CATGGTTGTGCCAAAACTTtTTTTTCCTATCTTTCCAGTGATATGATCAATTGATCACTG

ATCAATACAGTGGAAGCTTGGCTTTATAAATGATGGAGGCTAGGGTTTTCTAGCCTCCGA

TGAGTTGGAGAAGGAGCCAGAGTCAAACTCTTTCTTCGACTCAAATAGGGGAAGGGAAGG

TCTTTCCTTCCTTCCCATTGTTTCTTGGGCTTGATGAGATTTTTATTTTAGAAAAATTTC

AAGCCTCTACAACCATATGAAATCATAATGTCAAAGCTAGAAAAGGAGATCTATGCCATA

ATATTCCAATTCCAAGCCTAATCAAAGAACCATCAATCCATTAACACTAACTTTAAGATA

CCTAAGTTCTCCCTAGCATTATCTATGGTAAGAAAATCTATTAATTAAAATTGCATAATT

ATATCTAAATCAGTCAAAGAACAAATAATATTCTCTCTTTCTTTATCAAAATTATACTCC

TTTACCAGGAAACTAATTCGAATCTTCCATAATATCTTTTGGATCAAAGAATTAATGTAT

TTAATTAGTTTCAAAATAACTCAAACCATCACACTTCTGCTATACACTCTAATCTAAATC

CATCGATTCCTCTGGGTTGACTAGGTGAATTCTAACAAAATACCGCTTAATATCGGAACC

AAGAAGATCCAAAATTTTAACTTAAGGCAAACTAGAACAAAACTTTTGCATCTTTTTATC

CTTACAAAATCTTGAGCATACCACATCAAAAGTAAACCTTGAGCCACTATCCATGTTTGA

AGCATGACATAAGCTTCGCCATCCTCTCAAAACTTAATAACTCTAGATAAATTTAAATTA

ATCCTGACTTCTCTAACAGTTCAATTAGACTATCAAGATCACCTTTTCTCTTGGAAAGTT

AACTCAAAATTCTAACAAGTTAGAAAACTCTAAATCAACATTCTTATTAACTTGTTTATT

TTTtATAGAGCTTCGTTCACTACAATTCTTAGTATCAATCGACAAACCACATGAACGCCC

CTTATATGTTAGACATATACAAGTCCACCAGAATCAATTTCTCTACTCAATTAAATATCG

ATAGCAAGATACTATAGACCTGCTCATAAGCCTAACTCTGATTAGAATTTAACACATCCA

ACTATCTCCAACAAATATAAGAAAGACCAAGTAAGCTGATCTAAAGATGATAATTTAAAT

TATCAAAGATTCTACCAAGATGCATATCTCATATCCAATTGATAAAATCTAATCCATTAA

TAGAATCAAACATACTTTTCTTTTACATGCCAGTTTCATATATGATCTTCTTATAGGTTT

GATTCTCGAAGAATGTTTATTTTTAACACTATGTAATTCTTTCTTAGGCCATATCCTAAA

CAACTTGCTAGTAAAGTCTAAAATTTTAATGATCAAACAATTAATAATAAAaTTAAAAAa

GTTATTATGATCTCCCCCTATATTAAGTTTAGAATTTCAAAAATATCTAAGTGACAATTG

AGCAAGTACACACAGCATAACACAATCTACCAATATATCATACTTTATTCTAGGGTCTAC

AGCTCCTATACTTAGGTCAAATCTTACTTATTGAAATTAGAGACATAACTTATCCATTCC

TTTTGTACTCATAATATGCCAAGTCTTATGCATAAATTTTTATCATAATGCTTAGTGAGC

TTAAACCTGAGCTTTGAATCTATTTCTACTATGTACATTACATCCCTAGTGATCACAACT

TTAAGTTCAAATATCAATTAAGTTATAATCCCTAATAATCATAACCTAGCTCTGACACTA

CTTTGTCATATCTCGATCCCAGCATCTGGATTGGCCACATGATGGCCGTATACTTTCTAG

GACAAGATCCTAAAGAATATGCAAGATTTTAAATTCATTACAATCTTAAAATCCCATGAG

TACTATTGATCTGAATTCAAAATGAATATTACACATTAACAAATACCAAACCTTGTATAA

TTTATAAAATTTGATCATCTGATTGGTATTGATGATATTCCATCTAATCAATTCTTTCAA
```

-continued

CCTTGATCCCACCTATAGTAAAATACATATATCCTATTACTCTGAAAATGAAAAGAAAGA

TGTGAGCTTCATAGATCAGTAAGAATTTTCACACATCAATATTAATATAATAATAAATAA

AAAaTTATCAATAGTTATTACTCATATAAATCTCATACAATAGGATATCACGATCATAAA

ATATATATAAAAAAaTATATTTTTTtGTATAATAAATCACATCAAATACTTTTCTCAATT

TATAGTGTATCAGATCCTATAATATTTAGGTGCTAGGCTCTAAATTATTACAACTATATT

TTCCACTCATGGCATGACATCGACATAGTGGCTAATCTCGTGGACTATCACAATCACATT

TTTAGCATGAGGTTGGACATAAGCATAGTGGCTAATCTAGAGGGTCATAAGTGCTCAACT

CTGACTACCACAATCATATTTATAGTCCATATTGGGATATCAATAAAATGGCTAGTTCAG

AAAACTACAAGTACTCAACTCTAAACTATCATAACCATTTTCTAGCCCATAATGATGCAT

CAACAAAATAGCAAGCCTAGAGCACCACAATCCACCATTCAAGGACACAATTCAATTAAT

AATTTAAGATCATATTTCTTTGTAAAATTTAATACATAAAATTACCAAAACCACTCAAGT

TGGGATAAGTGACATGTGATATATAACTTTATACAGAATCATATATATACTTAAGAAATA

AATGTATAGCATATAACTATCAAAAACTATATAGATCAAAATCATTAATTCACAAAAATA

ATTTTTATATAAATAGATGATTATTATCCAGAAATTCTTATCTCTACTAATGACAAACTC

GGTTACAACTATTTTCTTGTCCATGCCTAATATATCCAACCAATCAACATAATTCCAACT

CATCCTTAATCAACCATTAGCATAaAAAATAAATAAATTACTCATAGTGTTTTAATTTCA

AAGCTTTAATATCCAAATTAATCTTAAATCTAATTTTTTtGTACTTTCTAATTTAAAATT

ATATAATTAAATAAGAAATTAAGATTTTATCTTGACTTGTAAACTAAAGCATAACATTTC

TTGCTTTGCATTTTCTTATTGGGATGATTGCTCTCATCCAAAATCAAAACCAACAATCAA

AAAAaGCTATAAAATAGTTATTGTCGATGGTGGAAAACTTAGAAGAAGAACAGTTGGTCG

AATAATAACATCCGATGGCCCAAGTGGGTTTGATCTAGATGCCTTAGCTAGTGATTCAAG

AATATGACAAAGATCGTCTATGATGGGTTTCGTGGTTACTTGATCAAGATCAAGGTGAAG

AAGGGCAAGATTAGTAGGATCCAATGACCAGTGTCAGCCCATCTAGGTGATCCAAATGAT

TAATCTATAATTAAGAGCCAAATTATAGCTCAATAGAAATTTGGCGATGATAAAATCCAA

CAATGCCCGGCAAGAGTCGGGTTAGGAGTGAACAATTATAGAGCAAACCTAGAATCTTCT

TTTGGGATCAACCTAGGGTCTACCATCAAGTCTTCTAAATCTATCTTTCTTtCTTTTTTT

TTtATGCCTAAATCCAAGAAGAGAGATAACAATAAAGGGAGAATGTAGAGAGAGATGTGA

GAGAGGGAAGAACAAATCGAATCTCTCTCTCTCTTCCTTGTCTTCTTTCTTCAAATAGAA

GATTTTCCTTTCTCCCTCTCGTCCTCCAAACATGGCAGTGGATGGCTGAGGCCAATAGCC

TGCGATGGCATCCAACAGTGAAGAGGCGACAACCCCAGTAGCAACAATGATGGCAGCTGG

TGGCAGCAGTGGGCAATCGGATATAAAGAAGAAGAAAATCAAAGCAAAATAAGGCAAGAG

GCCTTGCTTTGATCCAATGAAGAGGACTTCAAGGTAATCGGTAGCAATGGTAAGCATCTG

CACCAGCTCAACCTTTGGTAATGGTCGCAATGGCAATAATGGCCATGGTGGCCAATGGTG

GATGAATCAAAGAAAATAGGGGATCCTTGGTGCGGCAAGATCTAATGGTCTTTCAAGAAG

ATCTTAGCCAACAATGGCTACACGAGGATAGGAAGGAAGGAGAGAAAGTGCCCATGAGAT

GGGAGGCGATGCCTCATCTCCTATGATGGTTCAACCACGATTGGGCTAAAACTTTTtTCT

CCTCCTTTTTtGACAATGCAATCAATTGATTTCTCAATAGAATGGAAGCTCAGCTTTATA

GACAATGGAGGCTAAGGTTTCCTAGCATCCAATGAGTTTGAGAAGAAGCAGGAGTCGGAC

TCCTTCGACTCAAACAAAGGAAAGGAAGGTCTTTCCTTCCTTCCTATTGTTTCTTGGGCT

TGATTTTGGGCCTATTTCGATGATGGGCTGGGTAGGGTATCACAACAGTTTTGTTTCTAA

ATTGTCATTATCAGGAAGAGTAATTCTTTGTACACCACATTCGATGTAGAAAAACTGCAC

-continued

```
CACTCCGCCTAATTGAGCCACATATAACCACCACTTTTCAATGTAATTTAGTATTCGCAA

TTCTGCTTTtTTTTTTGAAATTTTGAATGGCAAAAATGTCCATCCTCTTTTAAAAAAATA

TGATATCTTATGGCCATATTATAATATCCTGCAATCAAATTATGATTTCTTATATACAGA

AAGTTATAATTTGACCACAGGATGTCATAAGAAAGGGGTGGACATTTTCATCATTTAAAA aTTTTtAAATTTTtAATAATGAAAATGTCCTTtCCTTTTtATGACTTTTGGAAGAAAAaT

TATGACATCCTATGTGTATTAAGACATAATTTGACCGCAAAATGTCATAATTTTTTtAAA

AAaGGATAAGCATTTTCATCATGCAAAATTTCAAAAGAAAAAGCAGAAATGCGGATATTA

AATACACATTGGAAAACGGTGCATTACATGACTCAATCAGATGGCGCGGTGCATTTTTC

TACACCAAGTGCGGTGTACAAAGAATTTCTCTTACTAGGAAATATCTTGAGTCTAGACCG

GCCCATTTGTCATTTAGACCAATCAAGGACTATGAATTTTGGTCCATAATAAGTATGAGA

TCGTCATGGGATTGAAAAGATGGGAAATAACTCCTCAGTTTGCCCCTTGACAGCTCACA

ATTCTTCAAATAATAGCATAAATCATTTTTTGAATCATCAAATTTATTACATTTTAGCCT

TTTAGAAGAAACCAATGCTATCCATATAAAAGGTATTTGTTTTCTATTAATGTCATTGCA

CTAATGAAGACAGCTTCAGCAAAGATAGAGCAGAAATCCTTTAAATTTTGTAAGATTCAT

TTGATCATCTTGAATTTTCTTTGATGATGTGGTTGCAGCAATACTATCAGCAGGAATCAG

CAAAGTTGCGCCACCAGATACAGATTTTACAAAATGCAAACAGGTGAACCTCAAACTTAG

ATCAGAACTGATTGGTCTCAAATACAATGTATATGCATTTTCAAAGCTTAAGATTATGTC

TTACCATGATTCCTAATCTACCACCTCTACCTTTCAGGCACTTAATGGGTGAAGCTTTGA

GCACTCTGACTGTAAAGGAGCTCAAGCAACTCGAAAACAGACTTGAAAGAGGTATCACAC

GGATCAGATCGAAGAAGGTAATCTGCATCTATATTTTCTTCAAACTGAGATCTTCATATT

GCCACCAGCACATGGCTTATCTGAAGTACATGATTATTAATCATGAAACATCATGCTATG

CAGCATTGAAAAGGGAAATCATTGTGGTTCACAGGTGGGGGTAGAGCATGTAAGATACGA

TGGGATCTAAAAATCGAGTCAATATAAATAAGTGTAATTTGTATTCTGTTCTGCCCCCAG

AAATCAGCATAGGCACCATGATGCATGTACCATCACCTAATAATATGCAACTTCAGAATT

TTTTGGCCCATCCAGCTCTTTAATTTGATTTTTGATGCATCTCATTGTTTTTTtCGCATC

AGCATGAGCTGTTGTTTGCAGAGATCGAGTATATGCAGAAAAGGGTAATATTCTAAACTT

ATTCCCTGCAACTTAATTCAAAGTATTGATTTCTTTCATTCATGTCTCCCTCTGAGTGGT

TCTTTGTTGTTGAACTGTAGGAAGTAGAACTCCAAAATGACAATATGTACCTCAGAGCTA

AGGTATCAATGAGAACAAAACTCTCTTCCTTGTCCTTGTCTGCTATTTCTTTCTGATATA

AACAAAAGAAATGGATATCATATTCGTAAAATATTTGATATCATCTATCATGCTTTTAGA

CTTATATGTGGTACTAGCATGGAGCCAAATTATATGCATTTTCATATGTTTAGAATGCAT

GACTAACGAAACAGTGACTTATGTTTAAAATGCATTTTCTCATTGATCAAATTTTTTTTt

ACATACTGTTGAATTTAACAGAGGAGAATAGTTTCCAAGAGATATTACAAAACAAGAGTT

TATTTGTATTTGCTTGTCTTCAAGAAATGAATTCAGCTCCACTAGTGGTAATCATGTGGT

CATCATCCATAGTGGCCTGTATGGCATGGCATAAAAACTAGGTGAGATTGTAAACAATCT

TCATGATGATAGTATATATATCATAGAACATTGAGCCTTTGTGTGGAGGCTCATCTGAAA

ATTAGTCATATCTGAATGAGAACCAGATTGATGGACCGTTTGAATCAAGAGATAGGACAA

GCAATACTCGAAAAAGTGCCTTAGTTACAGCCCAAATTCTGGATTGCTGATTTCTCTATT

TATCGATGCACCAACACCCTTCATGGGCAAGAATATTGTTTAAATCAGTGTTGCATTTGA

CTTCAAACCTCTAACATCTCAACAACCATAACTGAAGCCCCTTCAAAGCTAAATGCCTG
```

-continued

```
TTAATTTGTTCTTCACAAAGAAAATGGCATTTTTTCCTAGATGTCCATACCGATACTAAC

GGTATTTTGGAGGCTTGATGATGTGCTAATGACACTTTGGATTCCTCAAAGAAATGGCTC

CTCTGCTCCATCTCGGTCACAAGTCTCTAAAATTTTCACTTGTTGTTTCCATTGATTCTA

TTTCTTTATATTTTATTTAGATCTTCACAGACACAGTCTCAAAGTAGCAAGGTGGCATCT

ACATTCTTATTTCTCACTTCAAAATTTTTGGTGTTCTCAGATAGCAGAGAATGAGCGAGC

ACAGCAAGCAGGTATTGTGCCGGCAGGGCCTGATTTTGATGCTCTTCCAACGTTTGATAC

CAGAAACTATTACCATGTCAATATGCTGGAGGCAGCACAACACTATTCACACCATCAAGA

CCAGACAACCCTTCATCTTGGATATGAAATGAAAGCTGATCCAGCTGCAAAAAATTTACT

TTAAGTATGTCGCTGCTTGTTAATGACATGTTCTAATAACATAGGCTACAAGACCTGTAC

TCTTACTGATAAAGGTGTGTTAGAAGACTTGTCTGATTTCTATATTCCTAATATCAATAG

ACATGTTAGTGTGCCTTAATTTGTCTTGATTTCAGTAATATTTTGCAGATTGGAAGAAAA

AGCACTTTTTTATTCATAGAAGTTCTCTCCACCAACCATCATCTATTGAGTAGATCAGAG

TAGCATAAATGACATGTGTATGCATATCCTAGAGCTATAATTGACATGCCAAATGAAAAA

CCTAAAATGCTGAAAGGAATCTCCACAATTATGGAGGAATTAGTACTTCTTAGACCACGA

AGCTAAAACTAGATCTGCAATCCTCATAAAGAATGGCTACCCCCTACTGCCGAGTGTCAC

CAAAACATTATTGAAGTTGCTAAGCCAAGCCCTCAAAGTTCTCTTTTGCTATGTTTCTCC

CCAGCTGCGAGCTTTTGATTTTGTTGCTTCTTCAAAGATCATGTACATGTAAGTGGTTTC

TTTTGCTGCTGTCTCTCGGATCTTTTTGCGTGATGCATATAGGCCTGGTAGATCACCAAA

ACCAGACTCGCCATTTGTGTAAGTCCAGGTTTTCCAGTAGTCCTGTGATTCTTGCCTCCA

GCTAATGCTTTAGCAGACCATTGCAAGCAAATCTCTGTCAGCAACTATATGGTCACTTGG

AGTAGATGGATATTAAACATGCTTGTCTTTTTGCTTATAGCCTTCAATTTATTTGATATT

ATAGTATTAACCCAAGCTCAAGCTCGACTCGATGAAAAATAGACAAAACTCGAGTTGAGC

TTGAATATCAATGGAGTTATACTCGAGTTCGAGATCAAGTCTTAGCTTACTAATAAGATA

TATATATATATATATATATATATATATATACAAACTCAAATAGGCTCATAAGTTTTTt

AAACTGAGTATCCTGTTATTCAAGGTTGATAATAATCGAGTTGAGTCAAGCTTGAATAGT

TTATAAGCAACTTTGACTCATTTGTATACATCGTAAGCTTCTAAAGATAGCCATAAGAGA

TCAGAGATGTCCATGCCTGTGGTACCAACCTATGGTAAGCATTAAGGAGGGTGGTACCAA

CCTATCGGCTGAAGTTTCGTTGGTGAATGTTAATTTTTGCAAATCTCTAACACTATAATA

TAAAAATCTCTAGGATCTTACATGGTCAAAAATGGTTGTAGACGTTATATGCTAAATAAT

GTGTTGTTGTCCATGTCAGGATCTAATGAAGAATAACCACTTGTTTTGTTGTGAGAATCT

AATCAGTGTAGTGCTATACAAGCCAATGATCTGTATTTAATTAGCTCCCAGTTGCTAGAT

GGAATCGTACTAAAGTTTTTTTTTttGGATTGAAGGTACTAAAGCATTTAAAAaTAAAA

AaTTTCTCACAATCCGGCATTAGCTTAGTTGGTAGAGCAGAGGACTTTAGTTGGTATTAA

TCAGCAATCACTAGGTCGCAGGTTTGAATTCGGCAAGTTAGATTTTTTAAATTAAATGCC

AATTATTTGTAGTTTTTtCTAAACAATTTGACACTATTTTTCAAAATTATGCAAGACAAA

AATTGAAAAATTCCAAGGTGTCATGTTATCCTTTAAAATTTTTACATCATAAACTTTAAA

TTATAATTTACAAATATTTATTTCATTTACAACAACAGAACATATAGCATGAGAAGAATT

ATGCAAAAGAATAACTAAGAATTTCTGATAAAATATACACCTTTTTCTGACCCCAATTTA

TATCACTAAATTCAAAGATGAGGATTATGCAATGTTGGAGCTAGTATGGCTGAAAATCTA

ACATCCTTGCTAAGCATTTCTGCTTTAGGAAGGCTAATATTCTTGAAAAAaCAAAaTAAT

TGGCTTGGGGTTTAAGACAGCTTCAAACTGGGAGTGGCTTACATGTATACAATCAGAACT
```

-continued

```
ACTATAAAAGCCATGGAAGCAGGATGGGAAAAAaGAAAATGATTTAGTAATTTTTTATTT
ATATTTAATTTTTTTtttATTAAGCTATCAACTATTTCCCTAAATATCATAAGACCCACAT
CAAAGCTATTAAAAACAAATAAAGGTTTTGCATCAATGTATTGGGTACATCCCAATCTTA
TTTCTCAAAAATGTTTTTGTGTCAACACATCTAACAATATCATTGTCAAACTTTTATATA
AAGCACCTACTACACAAGCTATACTACACTCTGCAAGTTAAACCCATTTATTTATCAATT
TTCTGCCAAATTATTTATTAATTATTTAAACAAAAAaTTTAAATTACTATAATGCTAAAC
AATTTTATAGCTACTTAAAAGAAGCATGTTCGGTTGCTAAACTATCTCACTTGCACATAT
CTTCCGTATACTTTATATCATTCCAAATTTTTTTCATAGGACTTATTTGGACAATCGGGA
AACATGTTTTCTTTACTATGAAATTGCATTCAAGAGTATTGACAAATCCCATTGTCTTTT
TtATTACTAAATATGCATTTTGTATGCTCATATACTAGTACATAAATCTATTGGTTTTTt
ATTCTCTTGGTTAGTATAAATTGACTATCTCAAGATAGCAATTAATATGTATTATATTAT
TCAATACTTTTAATCTTGCCTTTGCTATGCCGCTTTTAGTTTCTTTAATATTAAATATCA
AATGAAATGATAACTAATCTCATTTTAGTGATATTGCCTGACATTTTGATATCCTATTCT
TCAATATCACTTGAGATATCAAGATATCTTGACTATTTAAGATCTATTTTCTATTGAAAT
GAAGGTAAATTGGTATGTTGGTTTGTCTTGGTTAGAAATGAATTTGAGACTTAAAATTTC
AATAGAATTTGATGAATGATTTAACCTGAATATATAAAAACAGCACGCAAGTTAGCTGAT
ATTCATCCTTTTGATCTTGTTTCAAATTATTTATCGGGATAATTGATATTTATGTATTTA
TAAAACAATATTACAGGTAAGAGAAATCAAAATACAATGATTCACTCCACATTCCTATCC
TCCACATCCAAAACTCCTCAAAATTAAAACCAAACTCTAAAATGCTCTCTATATATTAAA
ATTTCAATGTAGCTTTTGATAATGTTATAAAAATAGTTGTTTTGATATAAATGGTTGTTG
AAGCTCATATGGATGATCCCTTAGAAACTGGAGTGTATTATAAATGATCGTTGAAGCTCG
TATGGATGATCCCTTAGAAACTGGAGTGTATTATAAATGATCGTTGAAGCTCGTATGGAT
GAGTCCTTAGAAATTGATATAAGAAATATTATTTCCTTCAAATGAAAAATATTATTCCCT
TGGTAAATAAATAAGAAATATTATTTCTTTTGTAAATAAATGAAAAATATTATTTTtCTT
TATAATTTAGATTAAAAATCTATAAAAGAGCTTGGAATGAAATGAGAATTGTTGCGGCCA
ACTCTCCGTCGCCTGTCGCCGGTAACGAGCACCCGCAAGACAGCATCCACATAGACCGAA
TTGATGTCCGACGAAGACCCTCCGATGCTTAAGTCAGATAAGGAAGTTGATGAACAATAA
TTTTTGAATGTAGAAAGTAGCAGAGTTCTGGCCCTGAGATGGCTTACCAGTACTGCTCAC
TTAACCCCTTTTTATAGATGCTTTTGATGTAACCGTCGAGCACATAGTCCCACTTTTTAT
GACGCTAAATTATCGGGCCATAAATATAAAATTAATGAGGCGTTAATTCTCCTTAATAGC
CGTGACACACAGTTGATAACCGTTTGTGACGGTTATGATATGTTGAGCAGATTAGCCGAT
CATATATCGGTAGAACCGACTATATGTCGGTAGAATCTATGAGCGACCATCGGCTAGTAG
TTCTGTTATGCCGACGGTCTAAGTCATTCACTGTCGATCGGTAGTAGTCGAATCATTAGT
CGGTCAGCCGATAGTAAGTCGGCGCGGTTCGCTCAGTCGGTCGATGAAGAGTCAGAACTG
CATGTTCAACCGATATGCAGTTGGAGTCGTGGTGACCAAAGTCTGAGGTCGGTCAGTTTA
CCCCAACAGTTACCCCCACTCTCAAAGTCCAAGGTGAACCGACGTGTATATTGTCACGTA
GTTCGTCATATTAGATGAAGGGAGTTATTTCTATCATATCGAACCTCGATTTTGATGTCG
CTTTCTTCGAGATATGGGCGATCGACTGCTTTGTCGTTGTGGCGGATACGGTCATCTTTA
AACTGTCACACTAATCAGACGATTCGGTATCAGTTGTCAGTGTCAGACATCATTTTGGAA
AATCAATTCGACGTCGGATGATATGATTCTGACAAATAGATTTGTGCCATATGTCTGAAT
```

```
GTTATTGGGTCGGATCTGTTTACGCGGATTAGGATGACGTGGCTCGATCTGGGGCAAATA
CGTCGAACCATCTGATTAATGGTCGGTCTAGATGTTGCCACATGTCACATCTGATAAATT
TTCGATTCAATCACCTTCATCTCCACTGTTGAGGGATCCTATATATATAGGATCGCTCTC
AACCAAACTTCTACTTTTCATTTTATCTTTCTTGGTGCCGAAACTCTGTCGGACAGTCGT
CCCAACGTCTGAGGTTGTTATTTTCGTCTTTTTCAGATCAAGTTTCTGTCTTTTCTTGAG
TCCTTTTTCTTTCAGAATCTCCGTCTTCTTTAGAATCTTGTCTCTTATGGCTAGGACTTC
TTCTTGGGACGGTCGGTTGGAGAATCCGACTGACGAATCTCAATCAGATCCAGAGGTTGA
GGTTTCTTCACTTTTGGAGTCAAATATCGAGCAGCTTCAGGAACAGTATTGTATCCCGGA
GCAGTTTCAGCTTTTTGCCCCTAGGGCTGATGGTCGGATGAATATCCCTTTTTTGGGCCA
GGTGGCCTTCTATGTCGAAGATTTTCGAGTGGATCTTCGATTTTTGATTTTAAAATTTAT
CCGAAATATTTTGGATTACTACGGACTTTGTCTGGCTCAGCTGGCACCGAACTTGATCTG
GCTGGTAATTAGTTTTGCCTTGTTGTGTCAGTTGCTACCGACTAAACCTCGTCCTTCTCT
TTTTCGAGTTTTCTTCATCCTCCGACCTCATCCGAAGATCCGAGGGTGGTGGTTCTTCAA
CCCTCGAAAAGATTTTTCTtTTATTACTGATCTTCTATCATCCATTCATAGATGGAAGAA
TCAATTCTTCTTCGCTTCCTCTACCCTTCCTTGGGGTTTTCCTTCTCGTTGGAGCGATCT
ACGAACTGATTGCACGACAACAGCCGAGTAGAGATTGACGATCGGGAGGACTTCCATTGA
CTGAAAGACATGACGGTCCTGGCACAGAAGGAGCTTGTGAACGAACAGACCCTTTATGAT
GCCGACCTTAGTTCGATTGCCCGATTAGATATAGTACAGTCGGTCGGTTATTTCGGACTT
TACTTTTCTTTTACTTGTTTAGTTGTACTGACTTCTATTGTAATTGCAGCCATGTAGCCG
AGGGTGCGAGTGTCGAGCATCGATATTTGTCAGCACGCTGCCAGGAAGAGGGCAGCGTCC
GAGGTTGGACCTTCTCGACCATCGATGAGGCATCATACTTTGGTGCAAGTTCGAGCGGCA
CTAGCTTCAGTCGTCGCTTCAATGCCGACTGAGGAACCCGATGCTCCATCTGCATCGGTT
CCTGAGCCGATCCCGATACTATCAGCCCCGACAGTGCTCCCTGCTGCATCATCCGAAGAA
AGGGTGGCAAGGAGAACTGCCGAAGCACCATCGGTAGTTCCATCAATTGAGGAGGTTTGG
GTCAGGGCTGGAGAATCTGAACAATCTGTGGCTGCGCCAGTTGCTCCTTCAGCTGGGGCG
CAGTCGAGTTCAAGTTTTCCCTCGCTTTCGAACATGGGACTGCCGGCAAGGGATCGGGGG
AAAGCTCTGGTGACTTCGACGGAAGATGCAGCATCGGAGGGCTACACGGTTCACTTCGAC
CTTCAAGTACCTGATGATAAATTGACCCTGGCCAATCCGACATTGGCCAAGCGACTGTGC
CAAGCCGCTCTTCCTTCGCTTTATCAGGAGCATCGAAAGAAACGGACAGTGGCCGAGATG
TTTTCATCCTTTTACTTGATGATAATTAGGGTAAGTTTCTTTTCTTCTTTTTTtCTTTTT
TTtAACCTAA
```

SEQ ID NO: 8220 SHELL predicted protein sequence

[dura]

MGRGKIEIKRIENTTSRQVTFCKRRNGL*L*KKAYELSVLCDAEVALIVFSS
RGRLYEYANNSIRSTIDRYKKACANSSNSGATIEINSQYYQQESAKLRHQ
IQILQNANRHLMGEALSTLTVKELKQLENRLERGITRIRSKKHELLFAEI
EYMQKREVELQNDNMYLRAKIAENERAQQAA

SEQ ID NO: 8221 SHELL predicted protein sequence

[pisifera, Zaire allele; sh$^{AVROS}$]

MGRGKIEIKRIENTTSRQVTFCKRRNGLLK

-continued

IQILQNANRHLMGEALSTLTVKELKQLENRLERGITRIRSKKHELLFAEI

EYMQKREVELQNDNMYLRAKIAENERAQQAA

SEQ ID NO: 8222 SHELL predicted protein sequence

[pisifera, Nigerian allele; sh$^{MPOB}$]

MGRGKIEIKRIENTTSRQVTFCKRRNGL*P*KKAYELSVLCDAEVALIVFSS

RGRLYEYANNSIRSTIDRYKKACANSSNSGATIEINSQYYQQESAKLRHQ

IQILQNANRHLMGEALSTLTVKELKQLENRLERGITRIRSKKHELLFAEI

EYMQKREVELQNDNMYLRAKIAENERAQQAA

SEQUENCE LISTING (8241 sequences)

SEQ ID NO: 1 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcaaggtttgaagtactaaagtatrgggagtcctgttcaggtttcggcac

SEQ ID NO: 2 - DNA, 50 bp, Artificial Sequence
  synthetic Elaeis guineensis (oil palm) single nucleotide polymorphism (SNP) in genomic region adjacent to shatterproof1 (SHELL) shell thickness gene
cggacagcacatggtacttgctgcrggacataccttagtatgcctcatga

SEQ ID NO: 3 - DNA, 50 bp, Artificial Sequence
  synthetic Elaeis guineensis (oil palm) single nucleotide polymorphism (SNP) in genomic region adjacent to shatterproof1 (SHELL) shell thickness gene
agcactcgagttggcccttagtctstcacttatagtggtaaactttgggc

SEQ ID NO: 4 - DNA, 50 bp, Artificial Sequence
  synthetic Elaeis guineensis (oil palm) single nucleotide polymorphism (SNP) in genomic region adjacent to shatterproof1 (SHELL) shell thickness gene
caagtgattgtgatgaatagttgaycccatgcatttttaggatcttgtgg

SEQ ID NO: 5 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggcaaaccttgaaaattaggagttkgggaaggtctggttggtgcagtcac

SEQ ID NO: 6 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtaggctatcaaagtaacattgtcygtagactccgtactttatatgaaag

SEQ ID NO: 7 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctttgaaatttaccattcattattwtagggttaacattttcttccaaaaa

SEQ ID NO: 8 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttgtctccgctgtagccactatcaracacactatgatcaaagttcacctt

SEQ ID NO: 9 - DNA, 50 bp, Artificial Sequence
  synthetic Elaeis guineensis (oil palm) single nucleotide polymorphism (SNP) in genomic region adjacent to shatterproof1 (SHELL) shell thickness gene
atggtttgaggtaccccggaacggrcgcataccagtcacatactgacatg

SEQ ID NO: 10 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctacttggacctgggtaatttggcraatgtgaagctggcccatctattgc

SEQ ID NO: 11 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggggaacaggggagggcgaggaatwtgtgtagtttgctattcttggggaa

SEQ ID NO: 12 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtaaaatagggagaggtggagggamggagaggagaagagggtgggaggat

SEQ ID NO: 13 - DNA, 50 bp, Artificial Sequence
  synthetic Elaeis guineensis (oil palm) single nucleotide polymorphism (SNP) in genomic region adjacent to shatterproof1 (SHELL) shell thickness gene
ataaaataatgtgttttacattgayccaatgtcatatcatccaaacttca

SEQ ID NO: 14 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgttcaccttgatggttttttcagygttcaaagaagataattccctttgt

SEQ ID NO: 15 - DNA, 50 bp, Artificial Sequence
  synthetic Elaeis guineensis (oil palm) single nucleotide polymorphism (SNP) in genomic region adjacent to shatterproof1 (SHELL) shell thickness gene
tagcaggcttagtgaaaccaatgaktatccaattactgtggggcaatcaa

SEQ ID NO: 16 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttgtcttaaatcttaccatcctcartgtgtggggaaggatccttccttct

SEQ ID NO: 17 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatggtttgccgaactgccccaaayggtactggtggccaactggcgatgg

SEQ ID NO: 18 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatgtatgcacacacacacacacayatatatacatacttatatatatagg

SEQ ID NO: 19 - DNA, 50 bp, Artificial Sequence
  synthetic Elaeis guineensis (oil palm) single nucleotide polymorphism (SNP) in genomic region adjacent to shatterproof1 (SHELL) shell thickness gene
gagaaaatagaaggggcttatgggmtttggctgggattcctaaattgaag

SEQ ID NO: 20 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgtttaagagtactatttttgagtmtaacgaactaatttacggaaaagtg

SEQ ID NO: 21 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggtggccaccgccgatgcctctacyggtctcccttttctttcctccctct

SEQ ID NO: 22 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcttaacagtttggattttttcttyctatattttaataagctcaccctaa

SEQ ID NO: 23 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatagggttggttcagcatatggaygctcgatatgttgcacgtactgagt

SEQ ID NO: 24 - DNA, 50 bp, Artificial Sequence
  synthetic Elaeis guineensis (oil palm) single nucleotide polymorphism (SNP) in genomic region adjacent to shatterproof1 (SHELL) shell thickness gene
cagttatgttactcgtgaggaattsccattaggataaacaaaaggttcat

SEQ ID NO: 25 - DNA, 50 bp, Artificial Sequence
  synthetic Elaeis guineensis (oil palm) single nucleotide polymorphism (SNP) in genomic region adjacent to shatterproof1 (SHELL) shell thickness gene
attcagtctaagtgtcctttatccrtttcttcctgttattccaatgctat

SEQ ID NO: 26 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcactgcatgtatgttagcatggcrcaaaatgttccttgccggcctttgg

SEQ ID NO: 27 - DNA, 50 bp, Artificial Sequence
  synthetic Elaeis guineensis (oil palm) single nucleotide polymorphism (SNP) in genomic region adjacent to shatterproof1 (SHELL) shell thickness gene
agcatggcacaaaatgttccttgcyggcctttggccagaacgcttcatgc

SEQ ID NO: 28 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggccagtccaagaatgtagttcccwattggtatagtgggaagaatacaaa

SEQ ID NO: 29 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctcgtttcaagaataagtcactaygatgattagatatgaaatatggtga

SEQ ID NO: 30 - DNA, 50 bp, Artificial Sequence
  synthetic Elaeis guineensis (oil palm) single nucleotide polymorphism (SNP) in genomic region adjacent to shatterproof1 (SHELL) shell thickness gene
acgcccacgactaagttcttcgccwgtgcctcagacttcgagaagaccag

SEQ ID NO: 31 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtctagatgtccctctttgagacaycgcatctcggcagagacttgttgat

SEQ ID NO: 32 - DNA, 50 bp, Artificial Sequence
  synthetic Elaeis guineensis (oil palm) single nucleotide polymorphism (SNP) in genomic region adjacent to shatterproof1 (SHELL) shell thickness gene
gttactgttgctgagatagctcctyagtctgttgtcgaagtggctcctca

SEQ ID NO: 33 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcagtctgttgtcgaagtggctccycaaccgctgatcgaagtggcccctc

SEQ ID NO: 34 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttttatccgatctcacctaacccratcttggtttaattgtcatatatag

SEQ ID NO: 35 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcctcatttggtcggactatatgaycttatttggacaattattttatatc

SEQ ID NO: 36 - DNA, 50 bp, Artificial Sequence
  synthetic Elaeis guineensis (oil palm) single nucleotide polymorphism (SNP) in genomic region adjacent to shatterproof1 (SHELL) shell thickness gene
aattctcaattctatatgctcccargcggattacttcggtaacttggtag

SEQ ID NO: 37 - DNA, 50 bp, Artificial Sequence
  synthetic Elaeis guineensis (oil palm) single nucleotide polymorphism (SNP) in genomic region adjacent to shatterproof1 (SHELL) shell thickness gene
attatcagtgataatgatttgaggyaaatcaaagtggcagacaattgatt

SEQ ID NO: 38 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaagagtttcgatgctggatttttygaggtagtagataagaatttttagt

SEQ ID NO: 39 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcaaaaaataggctgaactggaccraaccagtgggttcggtatggtatca

SEQ ID NO: 40 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatgatatcggttggcaatcgataygggttttggtatcaagtccgcaaat

SEQ ID NO: 41 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatcgatatgggttttggtatcaaktccgcaaatcttggtttgaagtatt

SEQ ID NO: 42 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggacattcagggacaataccttcargattagctaaaattaaaccagctcc

SEQ ID NO: 43 - DNA, 50 bp, Artificial Sequence
  synthetic Elaeis guineensis (oil palm) single nucleotide polymorphism (SNP) in genomic region adjacent to shatterproof1 (SHELL) shell thickness gene
actttagaggttgatcatttaagaygacgattgagtgggcttggaaataa

SEQ ID NO: 44 - DNA, 50 bp, Artificial Sequence
  synthetic Elaeis guineensis (oil palm) single nucleotide polymorphism (SNP) in genomic region adjacent to shatterproof1 (SHELL) shell thickness gene
acttcaactggtttggacaataatkggggtgaatcgagatatttcttaag

SEQ ID NO: 45 - DNA, 50 bp, Artificial Sequence
  synthetic Elaeis guineensis (oil palm) single nucleotide polymorphism (SNP) in genomic region adjacent to shatterproof1 (SHELL) shell thickness gene
cggtgtaatcaatacaaatcctccrgttgtcatttgcatttttgaccata

SEQ ID NO: 46 - DNA, 50 bp, Artificial Sequence
  synthetic Elaeis guineensis (oil palm) single nucleotide polymorphism (SNP) in genomic region adjacent to shatterproof1 (SHELL) shell thickness gene
gctccgaatcaacattcaatttatstacaataacattggcagaaattcca

SEQ ID NO: 47 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgaagaaaagatatcggttattttyttaaatcagtccttaattgagatcc

SEQ ID NO: 48 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtggttataggcaaagtgatttctycttcagcagctacgggattttcaga

SEQ ID NO: 49 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaggagtttggacttcttgaacatyagtatcagaaaaaaaaataacattg

SEQ ID NO: 50 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcctgagcatacttttggattcggrttagcatttgatcgtaggtgtccga

SEQ ID NO: 51 - DNA, 50 bp, Artificial Sequence
  synthetic Elaeis guineensis (oil palm) single nucleotide polymorphism (SNP) in genomic region adjacent to shatterproof1 (SHELL) shell thickness gene
gttgtccgatcccatctcaacagcyatttcgatcatgcattccgatagat

SEQ ID NO: 52 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctgctcccttcttttatttctttcmtttttctttttcttctttccttcca

SEQ ID NO: 53 - DNA, 50 bp, Artificial Sequence
  synthetic Elaeis guineensis (oil palm) single nucleotide polymorphism (SNP) in genomic region adjacent to shatterproof1 (SHELL) shell thickness gene
gactcattgaaatttttgacttcamgcatgacgtattgaagtgcactgta

SEQ ID NO: 54 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaatttcttgagaaaaaagggatygtaggtcaaaatcttgcttatcttg

SEQ ID NO: 55 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatcttgggaatgattcccaagttrtacttccatcagccgtttttcaaga

SEQ ID NO: 56 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggatcttgatggattggctgatgaytgtgttgggacagaactttttgagg

SEQ ID NO: 57 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttgaggaattgcctctcattgctgytttatggtacattggagttgttgta

SEQ ID NO: 58 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgaaggttgaatagcttctggtccrcctcttggagaagatggtgaaggca

SEQ ID NO: 59 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaattattgtgctttctaatttacyatttttcacaatcttttgggcaagc

SEQ ID NO: 60 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttatggtttttaaactatggcttkgatgttaacagataatgaagctgcc

SEQ ID NO: 61 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttcattttttgactccttttttaasccaggtttgctcatcattcacttat

SEQ ID NO: 62 - DNA, 50 bp, Artificial Sequence
  synthetic Elaeis guineensis (oil palm) single nucleotide polymorphism (SNP) in genomic region adjacent to shatterproof1 (SHELL) shell thickness gene
atctaacggggctagccaaaccaaygctccatctgagctatctgatccct

SEQ ID NO: 63 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgcagaaataaggttggagttggamaaagtcagaaaggtggcacaaaaga

SEQ ID NO: 64 - DNA, 50 bp, Artificial Sequence
  synthetic Elaeis guineensis (oil palm) single nucleotide polymorphism (SNP) in genomic region adjacent to shatterproof1 (SHELL) shell thickness gene
caccatggctcaatcgaagcgcccrcgtgctgaagcttttgagggtcgat

SEQ ID NO: 65 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttgttttgtaatttggattggccratcttttgtaccagagtaatattaa

SEQ ID NO: 66 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaccttgttgtatgatgagctgacytgttagtagaaagattcttaagttc

SEQ ID NO: 67 - DNA, 50 bp, Artificial Sequence
  synthetic Elaeis guineensis (oil palm) single nucleotide polymorphism (SNP) in genomic region adjacent to shatterproof1 (SHELL) shell thickness gene
cagcttggctcgacttgggtcatarctccaagcttattgaaggggttctc

SEQ ID NO: 68 - DNA, 50 bp, Artificial Sequence
  synthetic Elaeis guineensis (oil palm) single nucleotide polymorphism (SNP) in genomic region adjacent to shatterproof1 (SHELL) shell thickness gene
tacatcccgtaccaaaccataccartggggagctggtccgatttagactg

SEQ ID NO: 69 - DNA, 50 bp, Artificial Sequence
  synthetic Elaeis guineensis (oil palm) single nucleotide polymorphism (SNP) in genomic region adjacent to shatterproof1 (SHELL) shell thickness gene
gattgaaccgatcggttcagtacgrtattggcccgaaccgtccgatgtca

SEQ ID NO: 70 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtttgatccaattcggtatggttcraagctggtttgattcggttcggtct

SEQ ID NO: 71 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtggattgagttggctttgccgatmtatggagcttccgaggatcctctta

SEQ ID NO: 72 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcaaatgattaagatttttagctcmgccatcagggataaggggctattcg

SEQ ID NO: 73 - DNA, 50 bp, Artificial Sequence
  synthetic Elaeis guineensis (oil palm) single nucleotide polymorphism (SNP) in genomic region adjacent to shatterproof1 (SHELL) shell thickness gene
gattttggagcttccaaggatcctyttatggggttatgcctcactttttg

SEQ ID NO: 74 - DNA, 50 bp, Artificial Sequence
  synthetic Elaeis guineensis (oil palm) single nucleotide polymorphism (SNP) in genomic region adjacent to shatterproof1 (SHELL) shell thickness gene
catccgctcaagatccattggcccratccaaccttgtctttaggccttgc

SEQ ID NO: 75 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatgtttgttatctcctgctttatytggtgagatatgtttgttatctcct

SEQ ID NO: 76 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtgagatatgtttgttatctcctgycttatttactcgtggcaggttgttg

SEQ ID NO: 77 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttctggctgcatcaacctttcagtraagctactattgcttttttagtttc

SEQ ID NO: 78 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttctaattattttagttttacagcygcacggatgttacctttgttgtttt

SEQ ID NO: 79 - DNA, 50 bp, Artificial Sequence
  synthetic Elaeis guineensis (oil palm) single nucleotide polymorphism (SNP) in genomic region adjacent to shatterproof1 (SHELL) shell thickness gene
gttatttgccactcttggaccgacygtcagttttccatagtttctagaca

SEQ ID NO: 80 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctgttaggactgtttatgagcaawgatattttctgtgcattgtcaatat

SEQ ID NO: 81 - DNA, 50 bp, Artificial Sequence
  synthetic Elaeis guineensis (oil palm) single nucleotide polymorphism (SNP) in genomic region adjacent to shatterproof1 (SHELL) shell thickness gene
tggcattgcgcatgcccaattttcrtatccacatgggcctctcttgaaag

SEQ ID NO: 82 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagtttggaagctacttatggctargatgttccaaatggctgtagccact

SEQ ID NO: 83 - DNA, 50 bp, Artificial Sequence
  synthetic Elaeis guineensis (oil palm) single nucleotide polymorphism (SNP) in genomic region adjacent to shatterproof1 (SHELL) shell thickness gene
atggctaggatgttccaaatggctktagccactctgtttcatggtagaat

SEQ ID NO: 84 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctgcaggaatcaggtgcatataatmattattgaaagaagagacagaaaac

SEQ ID NO: 85 - DNA, 50 bp, Artificial Sequence
  synthetic Elaeis guineensis (oil palm) single nucleotide polymorphism (SNP) in genomic region adjacent to shatterproof1 (SHELL) shell thickness gene
cattgatttagatgaagatgaagawgactgctcaactgccttaaaggaaa

SEQ ID NO: 86 - DNA, 50 bp, Artificial Sequence
  synthetic Elaeis guineensis (oil palm) single nucleotide polymorphism (SNP) in genomic region adjacent to shatterproof1 (SHELL) shell thickness gene
acttcttagagtataaatttgaagygagttgttttcctctcgggagatag

SEQ ID NO: 87 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggattatgaaggaatatgtgatgakctgtttctttgaaggttgttttctc

SEQ ID NO: 88 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgcgagctgcttatcaggttccacmtgtgagccacaaagttaggtacact

SEQ ID NO: 89 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcaagtgtttagatctacagaatcwtgcatctctagcatgtgtctgggtt

SEQ ID NO: 90 - DNA, 50 bp, Artificial Sequence
  synthetic Elaeis guineensis (oil palm) single nucleotide polymorphism (SNP) in genomic region adjacent to shatterproof1 (SHELL) shell thickness gene
attgttggaattttgctactggaasttttgctagatgcacggtctgattc

SEQ ID NO: 91 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttttgctactggaacttttgctagwtgcacggtctgattcactgagattg

SEQ ID NO: 92 - DNA, 50 bp, Artificial Sequence
  synthetic Elaeis guineensis (oil palm) single nucleotide polymorphism (SNP) in genomic region adjacent to shatterproof1 (SHELL) shell thickness gene
tagtttattcaatataataaattcyacgacttcaacttctgcacctgtat

SEQ ID NO: 93 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccaccaaacaactagaattggagcyatttattttcattctccttctacag

SEQ ID NO: 94 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctaggccttggggactctaactcaracgagactgggatcccgtattaggc

SEQ ID NO: 95 - DNA, 50 bp, Artificial Sequence
  synthetic Elaeis guineensis (oil palm) single nucleotide polymorphism (SNP) in genomic region adjacent to shatterproof1 (SHELL) shell thickness gene
tacccctattggcccacagaaatcratagttggcttatttatgagtaaca

SEQ ID NO: 96 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaaggcacaagcacgtcatagtcrtaatagaggcgtgtcttctgcaatc

SEQ ID NO: 97 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctagggtaacgctcgaacatcagaygcagatccaaaaaaagacttgagcc

SEQ ID NO: 98 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctttcctcactacttactggctamcgcatttgggagagtcaactcccat

SEQ ID NO: 99 - DNA, 50 bp, Artificial Sequence
  synthetic Elaeis guineensis (oil palm) single nucleotide polymorphism (SNP) in genomic region adjacent to shatterproof1 (SHELL) shell thickness gene
catcggataagatgacgtccgccaycaaggtccaaatagggaggaatggt

SEQ ID NO: 100 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttctctcagaatcaacttcgatcgraacttattttgtagatcacactgct

SEQ ID NO: 101 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttaacttggaattttttatgttagyaaaagcaacaaattttttctctcga

SEQ ID NO: 102 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctcttctgcccccctttgatcctyttgtgtgcttgcaaatctctatcaa

SEQ ID NO: 103 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttacttcttccatcaacttggagckgttgtcgatcggtattttgctatcg

SEQ ID NO: 104 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcatttcaaaatctaaatatgatcygcagcgtataccaacaatggttgca

SEQ ID NO: 105 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggaatgaatgattgttgcttttttytttttgcatctaacttgcatcattc

SEQ ID NO: 106 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtgatcagggaggaattattctgasactaccaccagggcatccttgctgc

SEQ ID NO: 107 - DNA, 50 bp, Artificial Sequence
  synthetic Elaeis guineensis (oil palm) single nucleotide polymorphism (SNP) in genomic region adjacent to shatterproof1 (SHELL) shell thickness gene
atgaattcatcattcgttttgtcaytttaagttcaacaatgccattgggt

SEQ ID NO: 108 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttaagttcaacaatgccattgggtytttatctcctcgatgttggtagcag

SEQ ID NO: 109 - DNA, 50 bp, Artificial Sequence
  synthetic Elaeis guineensis (oil palm) single nucleotide polymorphism (SNP) in genomic region adjacent to shatterproof1 (SHELL) shell thickness gene
gggtttttatctcctcgatgttggkagcagcttaaatatttcttttcatg

SEQ ID NO: 110 - DNA, 50 bp, Artificial Sequence
  synthetic Elaeis guineensis (oil palm) single nucleotide polymorphism (SNP) in genomic region adjacent to shatterproof1 (SHELL) shell thickness gene
agcttaaatatttcttttcatgccktgaaagtggttggcagtgtttggtg

SEQ ID NO: 111 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaaaacatgttctatggtttctatrtcaggttttattagtgtaagagaaa

SEQ ID NO: 112 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggacatcaactcagaatgccagttkgaagggttaatgcttctaataagcc

SEQ ID NO: 113 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccctaaaagatgaaggcatgactcrgtacaggattcatagaccttcttaa

SEQ ID NO: 114 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgagcccctaaaagatgaaggcatkactcagtacaggattcatagacctt

SEQ ID NO: 115 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttaagtgacttgattaagaaattrtgaagcacagattaaatcaagatca

SEQ ID NO: 116 - DNA, 50 bp, Artificial Sequence
  synthetic Elaeis guineensis (oil palm) single nucleotide polymorphism (SNP) in genomic region adjacent to shatterproof1 (SHELL) shell thickness gene
ataaggaaagatgactgttgtctgsatgtgtcggaccatccagataccgg

SEQ ID NO: 117 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcaaatcatcattaatttctatttyatgaatataataagattaaatcata

SEQ ID NO: 118 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttacctcgttcattttagatcttcwgacttcgttagaagaatcaactaat

SEQ ID NO: 119 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgattatttaaaaataaataaagarcgtaagatccacttacctcgttcat

SEQ ID NO: 120 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttttcatatcacacgtgctgatcyttattttataaaaaatatgatttca

SEQ ID NO: 121 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaatatattcataaaatcaatgctyataataaaatataatttttcatatc

SEQ ID NO: 122 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttatatcttttttttaaagcatayatatacataaataaaaaaataataa

SEQ ID NO: 123 - DNA, 50 bp, Artificial Sequence
  synthetic Elaeis guineensis (oil palm) single nucleotide polymorphism (SNP) in genomic region adjacent to shatterproof1 (SHELL) shell thickness gene
atacccgttggcagggctatgtttygtgtggatgctagctctggatgtcg

SEQ ID NO: 124 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctattatacctgtgatagggccatrtttcttaatcgacagagttcttaat

SEQ ID NO: 125 - DNA, 50 bp, Artificial Sequence
  synthetic Elaeis guineensis (oil palm) single nucleotide polymorphism (SNP) in genomic region adjacent to shatterproof1 (SHELL) shell thickness gene
gatatattgctcccagatattcgtkctaagatcactattatacctgtgat

SEQ ID NO: 126 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatcatgaatcataaatcattcttrtcatgtattcatgtcaagttttgat

SEQ ID NO: 127 - DNA, 50 bp, Artificial Sequence
  synthetic Elaeis guineensis (oil palm) single nucleotide polymorphism (SNP) in genomic region adjacent to shatterproof1 (SHELL) shell thickness gene
atataaaataaaatatttcatagarcatataataaaataaattataaacc

SEQ ID NO: 128 - DNA, 50 bp, Artificial Sequence
  synthetic Elaeis guineensis (oil palm) single nucleotide polymorphism (SNP) in genomic region adjacent to shatterproof1 (SHELL) shell thickness gene
atatttaaaaaataacagataatayaaaataaaatatttcatagaacata

SEQ ID NO: 129 - DNA, 50 bp, Artificial Sequence
  synthetic Elaeis guineensis (oil palm) single nucleotide polymorphism (SNP) in genomic region adjacent to shatterproof1 (SHELL) shell thickness gene
atctaaacctcatctacaaaatttycaagcttgcatcgcagatctctaaa

SEQ ID NO: 130 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctaaatccaaaatcaaatataaatycatatatcaaaatccataattactt

SEQ ID NO: 131 - DNA, 50 bp, Artificial Sequence
  synthetic Elaeis guineensis (oil palm) single nucleotide polymorphism (SNP) in genomic region adjacent to shatterproof1 (SHELL) shell thickness gene
agcatctaaatccaaaatcaaatayaaattcatatatcaaaatccataat

SEQ ID NO: 132 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccatgataacacgaagccaatccawcataatcatccaaaatccatcaaat

SEQ ID NO: 133 - DNA, 50 bp, Artificial Sequence
  synthetic Elaeis guineensis (oil palm) single nucleotide polymorphism (SNP) in genomic region adjacent to shatterproof1 (SHELL) shell thickness gene
acataacacgaccatgctaccgaargatggagcccatgataacacgaagc

SEQ ID NO: 134 - DNA, 50 bp, Artificial Sequence
  synthetic Elaeis guineensis (oil palm) single nucleotide polymorphism (SNP) in genomic region adjacent to shatterproof1 (SHELL) shell thickness gene
agggttgatctgagtacgagaagtrttaactctggaatgaagtgggaggt

SEQ ID NO: 135 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaggacatgataactttgctgattktgatgttaatttttttgcaaaaaaa

SEQ ID NO: 136 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagcatgatggtctgaattaattaraaatattaatcttttaaattaaaag

SEQ ID NO: 137 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatacgttagttataaataaggaargattttactgataataaaagaatgc

SEQ ID NO: 138 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaaggattttactgataataaaagratgctagagagaaaatctatctgat

SEQ ID NO: 139 - DNA, 50 bp, Artificial Sequence
  synthetic Elaeis guineensis (oil palm) single nucleotide polymorphism (SNP) in genomic region adjacent to shatterproof1 (SHELL) shell thickness gene
agtcaacgatatattagaccttttraaattttaagccgagtaggagatgt

SEQ ID NO: 140 - DNA, 50 bp, Artificial Sequence
  synthetic Elaeis guineensis (oil palm) single nucleotide polymorphism (SNP) in genomic region adjacent to shatterproof1 (SHELL) shell thickness gene
cacaatgtctttcatgtttcatcaytgagaaaatttatacctgatccaaa

SEQ ID NO: 141 - DNA, 50 bp, Artificial Sequence
  synthetic Elaeis guineensis (oil palm) single nucleotide polymorphism (SNP) in genomic region adjacent to shatterproof1 (SHELL) shell thickness gene
atgtctttcatgtttcatcactgaraaaatttatacctgatccaaataat

SEQ ID NO: 142 - DNA, 50 bp, Artificial Sequence
  synthetic Elaeis guineensis (oil palm) single nucleotide polymorphism (SNP) in genomic region adjacent to shatterproof1 (SHELL) shell thickness gene
catgtttcatcactgagaaaatttrtacctgatccaaataatgtggtaaa

SEQ ID NO: 143 - DNA, 50 bp, Artificial Sequence
  synthetic Elaeis guineensis (oil palm) single nucleotide polymorphism (SNP) in genomic region adjacent to shatterproof1 (SHELL) shell thickness gene
taaaattttaaataaaaaaatatcyttcttattctgaaaaaattatgaca

SEQ ID NO: 144 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctttatgacttttgaaagaaaaatyaagacattctgcatgtaaaaagtca

SEQ ID NO: 145 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaccatagatcatctcatgactcmatgtgaatactcctatctcacataa

SEQ ID NO: 146 - DNA, 50 bp, Artificial Sequence
  synthetic Elaeis guineensis (oil palm) single nucleotide polymorphism (SNP) in genomic region adjacent to shatterproof1 (SHELL) shell thickness gene
catgactccatgtgaatactcctawctcacataaaaacatctgctacaac

SEQ ID NO: 147 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttaaacttaatttaataccccctcktgacagcctctaggctctttcctca

SEQ ID NO: 148 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctaggctctttcctcaatttcttwacttattgttttttattcttcttta

SEQ ID NO: 149 - DNA, 50 bp, Artificial Sequence
  synthetic Elaeis guineensis (oil palm) single nucleotide polymorphism (SNP) in genomic region adjacent to shatterproof1 (SHELL) shell thickness gene
agcttcctgtatttggccactctgyctcctctaagcttccatatttggcc

SEQ ID NO: 150 - DNA, 50 bp, Artificial Sequence
  synthetic Elaeis guineensis (oil palm) single nucleotide polymorphism (SNP) in genomic region adjacent to shatterproof1 (SHELL) shell thickness gene
cattattttttcagagatctgcagraaaggagagcacttgaaagagatta

SEQ ID NO: 151 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttagcagttattttttcgatatartctcaatgctacagactctttagtt

SEQ ID NO: 152 - DNA, 50 bp, Artificial Sequence
  synthetic Elaeis guineensis (oil palm) single nucleotide polymorphism (SNP) in genomic region adjacent to shatterproof1 (SHELL) shell thickness gene
cagttattttttcgatataatctcratgctacagactctttagtttatgt

SEQ ID NO: 153 - DNA, 50 bp, Artificial Sequence
  synthetic Elaeis guineensis (oil palm) single nucleotide polymorphism (SNP) in genomic region adjacent to shatterproof1 (SHELL) shell thickness gene
agcctagtaaattatcgaagttatmtataatgatgtgggatgacaacatg

SEQ ID NO: 154 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgcttagttgtcttccttctgtaakgaccacacatgaagcactccagacc

SEQ ID NO: 155 - DNA, 50 bp, Artificial Sequence
  synthetic Elaeis guineensis (oil palm) single nucleotide polymorphism (SNP) in genomic region adjacent to shatterproof1 (SHELL) shell thickness gene
acatctgctcttcctatcatggacygaaaaattgtcagcataaagacata

SEQ ID NO: 156 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcaagaaaatcccagcaaatacagyttttctgaaacaatcataagataca

SEQ ID NO: 157 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaggaaatggctcgaccgaacaggrtagaacagggtctcgccttttcatc

SEQ ID NO: 158 - DNA, 50 bp, Artificial Sequence
  synthetic Elaeis guineensis (oil palm) single nucleotide polymorphism (SNP) in genomic region adjacent to shatterproof1 (SHELL) shell thickness gene
aggaaatggctcgaccgaacagggyagaacagggtctcgccttttcatca

SEQ ID NO: 159 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaacagggtagaacagggtctcgcyttttcatcaatttttccaacgatcc

SEQ ID NO: 160 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagccatgggaaggaggggaaggargagaggaaggagggccggggcttac

SEQ ID NO: 161 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttcagattcgaggaaatttaactgragtctgaattctaataagatgtgaa

SEQ ID NO: 162 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttattgcagttgtatttgttggagmcattgggggtatatttggaagtcta

SEQ ID NO: 163 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttgttgtcattcttggattgtgttkatatactctagacattagcttaaat

SEQ ID NO: 164 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtttctgacagggtctaattatttkcaggaaaggtgcacctttcaagatc

SEQ ID NO: 165 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcttggtctccatgagcactgtccyaccgttggccgctcaggcaacttca

SEQ ID NO: 166 - DNA, 50 bp, Artificial Sequence
  synthetic Elaeis guineensis (oil palm) single nucleotide polymorphism (SNP) in genomic region adjacent to shatterproof1 (SHELL) shell thickness gene
caacttcaagaactttcaatgcccrcaaggtcattacaatgaccttgctt

SEQ ID NO: 167 - DNA, 50 bp, Artificial Sequence
  synthetic Elaeis guineensis (oil palm) single nucleotide polymorphism (SNP) in genomic region adjacent to shatterproof1 (SHELL) shell thickness gene
tattgaaacaatgtctctagccaargctgcagtgctcttcagagagcttg

SEQ ID NO: 168 - DNA, 50 bp, Artificial Sequence
  synthetic Elaeis guineensis (oil palm) single nucleotide polymorphism (SNP) in genomic region adjacent to shatterproof1 (SHELL) shell thickness gene
actaaaaaaatcttgacccaaaccygagccagatgcgaaaagatgtaaaa

SEQ ID NO: 169 - DNA, 50 bp, Artificial Sequence
  synthetic Elaeis guineensis (oil palm) single nucleotide polymorphism (SNP) in genomic region adjacent to shatterproof1 (SHELL) shell thickness gene
gttaaatgaagtgtcaatgctcttmtgaaacctgaaatctgttttcttgc

SEQ ID NO: 170 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttcttcttttaagctatcaaagagscccctccacagagtttgttgaggct

SEQ ID NO: 171 - DNA, 50 bp, Artificial Sequence
  synthetic Elaeis guineensis (oil palm) single nucleotide polymorphism (SNP) in genomic region adjacent to shatterproof1 (SHELL) shell thickness gene
attctccaccagatagctgcatgayatttcttgttgtttctgcttattgc

SEQ ID NO: 172 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggacaacaaattacaaggtagaacwagcaaaaatgactcgacgactgcca

SEQ ID NO: 173 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaccttctcagctaagaaagcaatrttttttaccgccctaatttgccaga

SEQ ID NO: 174 - DNA, 50 bp, Artificial Sequence
  synthetic Elaeis guineensis (oil palm) single nucleotide polymorphism (SNP) in genomic region adjacent to shatterproof1 (SHELL) shell thickness gene
catgcatttccaggtatttagatcyggaacggtggcaggcactgccatcc

SEQ ID NO: 175 - DNA, 50 bp, Artificial Sequence
  synthetic Elaeis guineensis (oil palm) single nucleotide polymorphism (SNP) in genomic region adjacent to shatterproof1 (SHELL) shell thickness gene
atttccaggtatttagatccggaayggtggcaggcactgccatccatcaa

SEQ ID NO: 176 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaactaaaagcatatttgattcaygatcgaaattagaatcagaatcgaa

SEQ ID NO: 177 - DNA, 50 bp, Artificial Sequence
  synthetic Elaeis guineensis (oil palm) single nucleotide polymorphism (SNP) in genomic region adjacent to shatterproof1 (SHELL) shell thickness gene
caaccaaacatgccttataggagcraggcagagagaaattcagtgactag

SEQ ID NO: 178 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcatctctcctctcaaacacccatmtctctcctcccgttttgctgctttc

SEQ ID NO: 179 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccgttttgctgctttcctccaaaastacaacttcatcatttagtaaattg

SEQ ID NO: 180 - DNA, 50 bp, Artificial Sequence
  synthetic Elaeis guineensis (oil palm) single nucleotide polymorphism (SNP) in genomic region adjacent to shatterproof1 (SHELL) shell thickness gene
tattttagagagagtaagcttaagygagaaagtctcttgactaaaaagat

SEQ ID NO: 181 - DNA, 50 bp, Artificial Sequence
  synthetic Elaeis guineensis (oil palm) single nucleotide polymorphism (SNP) in genomic region adjacent to shatterproof1 (SHELL) shell thickness gene
atggagcttgatcctaaggggtccractgaacaagtctctcatgactaat

SEQ ID NO: 182 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggggtccaactgaacaagtctctcrtgactaatcttcatgaggattcgaa

SEQ ID NO: 183 - DNA, 50 bp, Artificial Sequence
  synthetic Elaeis guineensis (oil palm) single nucleotide polymorphism (SNP) in genomic region adjacent to shatterproof1 (SHELL) shell thickness gene
caaatttttgctcgtggtccctttyctttggccaattaacttatagctct

SEQ ID NO: 184 - DNA, 50 bp, Artificial Sequence
  synthetic Elaeis guineensis (oil palm) single nucleotide polymorphism (SNP) in genomic region adjacent to shatterproof1 (SHELL) shell thickness gene
cctttcctttggccaattaacttayagctctccaagaatgatgatctaat

SEQ ID NO: 185 - DNA, 50 bp, Artificial Sequence
  synthetic Elaeis guineensis (oil palm) single nucleotide polymorphism (SNP) in genomic region adjacent to shatterproof1 (SHELL) shell thickness gene
accaggtagaaatactattaatcargtagccatttggttgtggatgcctg

SEQ ID NO: 186 - DNA, 50 bp, Artificial Sequence
  synthetic Elaeis guineensis (oil palm) single nucleotide polymorphism (SNP) in genomic region adjacent to shatterproof1 (SHELL) shell thickness gene
taagagtttgtttataaagagttaycgaatctctgctagccatgtaacca

SEQ ID NO: 187 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctatgcttcctgtaaaaatcatgawctggatagctccttgcccaagccta

SEQ ID NO: 188 - DNA, 50 bp, Artificial Sequence
  synthetic Elaeis guineensis (oil palm) single nucleotide polymorphism (SNP) in genomic region adjacent to shatterproof1 (SHELL) shell thickness gene
accagatcatcgtctattggtgttdctctttttgtgtttcaagcttcgac

SEQ ID NO: 189 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctccaaagactctaaaaaattcaayagatcaaatgatttgattcacccac

SEQ ID NO: 190 - DNA, 50 bp, Artificial Sequence
  synthetic Elaeis guineensis (oil palm) single nucleotide polymorphism (SNP) in genomic region adjacent to shatterproof1 (SHELL) shell thickness gene
gttacaagttgagttgggcctagarcacaccttgattgagcagtatgtca

SEQ ID NO: 191 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctgaagcttttagtgcccagactyaatctcaaataagctctataggggc

SEQ ID NO: 192 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctcaatctcaaataagctctatagrggcgtctgtttccatatcttagtat

SEQ ID NO: 193 - DNA, 50 bp, Artificial Sequence
  synthetic Elaeis guineensis (oil palm) single nucleotide polymorphism (SNP) in genomic region adjacent to shatterproof1 (SHELL) shell thickness gene
catatgcattgtctagatatttgtwgtatcctagaaatatatttgtctaa

SEQ ID NO: 194 - DNA, 50 bp, Artificial Sequence
  synthetic Elaeis guineensis (oil palm) single nucleotide polymorphism (SNP) in genomic region adjacent to shatterproof1 (SHELL) shell thickness gene
gggttttcaaagacctatgtttacytggtgtaataatcaactaggatcta

SEQ ID NO: 195 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctgagctcatggccggtcattttkcttctaatcattgtccttcattgat

SEQ ID NO: 196 - DNA, 50 bp, Artificial Sequence
  synthetic Elaeis guineensis (oil palm) single nucleotide polymorphism (SNP) in genomic region adjacent to shatterproof1 (SHELL) shell thickness gene
taggcctaaacctttttggtttgaraaattttgactctccgagcacatat

SEQ ID NO: 197 - DNA, 50 bp, Artificial Sequence
  synthetic Elaeis guineensis (oil palm) single nucleotide polymorphism (SNP) in genomic region adjacent to shatterproof1 (SHELL) shell thickness gene
acaaggaaccattcttctggtgtgygactttctattgttctacataacac

SEQ ID NO: 198 - DNA, 50 bp, Artificial Sequence
  synthetic Elaeis guineensis (oil palm) single nucleotide polymorphism (SNP) in genomic region adjacent to shatterproof1 (SHELL) shell thickness gene
gccttagttgatgaaatcattgtcrcttaggtaacttttttcaagttggt

SEQ ID NO: 199 - DNA, 50 bp, Artificial Sequence
  synthetic Elaeis guineensis (oil palm) single nucleotide polymorphism (SNP) in genomic region adjacent to shatterproof1 (SHELL) shell thickness gene
cttaataataagttggagtatcttyagttgaaggaagtctcttatagtgg

SEQ ID NO: 200 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatcttcagttgaaggaagtctctkatagtggtttgcctcattaagatca

SEQ ID NO: 201 - DNA, 50 bp, Artificial Sequence
  synthetic Elaeis guineensis (oil palm) single nucleotide polymorphism (SNP) in genomic region adjacent to shatterproof1 (SHELL) shell thickness gene
agtggtttgcctcattaagatcatwaggatttactgcacacccttaggct

SEQ ID NO: 202 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaggatttactgcacacccttaggstttataatcttgacttgaatcaata

SEQ ID NO: 203 - DNA, 50 bp, Artificial Sequence
  synthetic Elaeis guineensis (oil palm) single nucleotide polymorphism (SNP) in genomic region adjacent to shatterproof1 (SHELL) shell thickness gene
cacacccttaggctttataatcttracttgaatcaataagaaatcttctg

SEQ ID NO: 204 - DNA, 50 bp, Artificial Sequence
  synthetic Elaeis guineensis (oil palm) single nucleotide polymorphism (SNP) in genomic region adjacent to shatterproof1 (SHELL) shell thickness gene
tagaatttcgtggcttaaggaagawaatagtagtactaaattttttcgct

SEQ ID NO: 205 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaatagtagtactaaattttttcrctactctactatacagaagagaaga

SEQ ID NO: 206 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttttttcgctactctactatacagmagagaagagctactaaaattactaa

SEQ ID NO: 207 - DNA, 50 bp, Artificial Sequence
  synthetic Elaeis guineensis (oil palm) single nucleotide polymorphism (SNP) in genomic region adjacent to shatterproof1 (SHELL) shell thickness gene
attagatggatctaaagttgacgaygatgttatgattcatcaatttgtat

SEQ ID NO: 208 - DNA, 50 bp, Artificial Sequence
  synthetic Elaeis guineensis (oil palm) single nucleotide polymorphism (SNP) in genomic region adjacent to shatterproof1 (SHELL) shell thickness gene
taaagttgacgacgatgttatgatkcatcaatttgtattcacttatttta

SEQ ID NO: 209 - DNA, 50 bp, Artificial Sequence
  synthetic Elaeis guineensis (oil palm) single nucleotide polymorphism (SNP) in genomic region adjacent to shatterproof1 (SHELL) shell thickness gene
cttaaatgaacttagcagattgagycactttttgattggttatgtttggt

SEQ ID NO: 210 - DNA, 50 bp, Artificial Sequence
  synthetic Elaeis guineensis (oil palm) single nucleotide polymorphism (SNP) in genomic region adjacent to shatterproof1 (SHELL) shell thickness gene
attgagccactttttgattggttakgtttggtattacccattttatcttc

SEQ ID NO: 211 - DNA, 50 bp, Artificial Sequence
  synthetic Elaeis guineensis (oil palm) single nucleotide polymorphism (SNP) in genomic region adjacent to shatterproof1 (SHELL) shell thickness gene
caacatgagcaactagtatgcgcartcactaacaatgaaattaaggaagt

SEQ ID NO: 212 - DNA, 50 bp, Artificial Sequence
  synthetic Elaeis guineensis (oil palm) single nucleotide polymorphism (SNP) in genomic region adjacent to shatterproof1 (SHELL) shell thickness gene
gatgttgttcttattgtgaaggatrcttcacaatatatatctatgccatg

SEQ ID NO: 213 - DNA, 50 bp, Artificial Sequence
  synthetic Elaeis guineensis (oil palm) single nucleotide polymorphism (SNP) in genomic region adjacent to shatterproof1 (SHELL) shell thickness gene
acaaacttttattacttgaatctcwaaaaagaataatcttattttaattt

SEQ ID NO: 214 - DNA, 50 bp, Artificial Sequence
  synthetic Elaeis guineensis (oil palm) single nucleotide polymorphism (SNP) in genomic region adjacent to shatterproof1 (SHELL) shell thickness gene
tattacttgaatctcaaaaaagaakaatcttattttaatttttgatccat

SEQ ID NO: 215 - DNA, 50 bp, Artificial Sequence
  synthetic Elaeis guineensis (oil palm) single nucleotide polymorphism (SNP) in genomic region adjacent to shatterproof1 (SHELL) shell thickness gene
taatacaacttaatcattgcaaatktttttacaaacaaactacttatcat

SEQ ID NO: 216 - DNA, 50 bp, Artificial Sequence
  synthetic Elaeis guineensis (oil palm) single nucleotide polymorphism (SNP) in genomic region adjacent to shatterproof1 (SHELL) shell thickness gene
atcatgtcttccttaatccatcctrtgcaaggtgccttttttcctacata

SEQ ID NO: 217 - DNA, 50 bp, Artificial Sequence
  synthetic Elaeis guineensis (oil palm) single nucleotide polymorphism (SNP) in genomic region adjacent to shatterproof1 (SHELL) shell thickness gene
atatgttttgattacccaaaagatyatgcattccttgatgcatgcacctg

SEQ ID NO: 218 - DNA, 50 bp, Artificial Sequence
  synthetic Elaeis guineensis (oil palm) single nucleotide polymorphism (SNP) in genomic region adjacent to shatterproof1 (SHELL) shell thickness gene
cattttggctttcaacttggattcrtaaagtgggtacaactccgtgtcaa

SEQ ID NO: 219 - DNA, 50 bp, Artificial Sequence
  synthetic Elaeis guineensis (oil palm) single nucleotide polymorphism (SNP) in genomic region adjacent to shatterproof1 (SHELL) shell thickness gene
acttggattcataaagtgggtacarctccgtgtcaactttattaataaat

SEQ ID NO: 220 - DNA, 50 bp, Artificial Sequence
  synthetic Elaeis guineensis (oil palm) single nucleotide polymorphism (SNP) in genomic region adjacent to shatterproof1 (SHELL) shell thickness gene
taataaatgataagctatcttcttrgtatcaaactactatgggcttaaca

SEQ ID NO: 221 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcggctagaaatgatccaactcttrctcatattttttctaatttatattg

SEQ ID NO: 222 - DNA, 50 bp, Artificial Sequence
  synthetic Elaeis guineensis (oil palm) single nucleotide polymorphism (SNP) in genomic region adjacent to shatterproof1 (SHELL) shell thickness gene
caatggaagactctttcatttgcaygaagagcaatcttaatgcaatcgat

SEQ ID NO: 223 - DNA, 50 bp, Artificial Sequence
  synthetic Elaeis guineensis (oil palm) single nucleotide polymorphism (SNP) in genomic region adjacent to shatterproof1 (SHELL) shell thickness gene
catttgcatgaagagcaatcttaaygcaatcgatcttaacttctatcccc

SEQ ID NO: 224 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttcatttcccttcctccattctacrtatattagagaagtacttttgtgcc

SEQ ID NO: 225 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctattgattggcatggtctacacrttcttgctcagagtattgtttgtgc

SEQ ID NO: 226 - DNA, 50 bp, Artificial Sequence
  synthetic Elaeis guineensis (oil palm) single nucleotide polymorphism (SNP) in genomic region adjacent to shatterproof1 (SHELL) shell thickness gene
atggtctacacgttcttgctcagartattgtttgtgcctccaaatcaaaa

SEQ ID NO: 227 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatattcaggtcgatatcaggaggktcagcttgttaagtttattacacct

SEQ ID NO: 228 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcagtctctttgcataatgtttcakctaccatatcctcttctacctcatc

SEQ ID NO: 229 - DNA, 50 bp, Artificial Sequence
  synthetic Elaeis guineensis (oil palm) single nucleotide polymorphism (SNP) in genomic region adjacent to shatterproof1 (SHELL) shell thickness gene
atactatttggagactttcgatttstatgaatgtcaagactttttgttgg

SEQ ID NO: 230 - DNA, 50 bp, Artificial Sequence
  synthetic Elaeis guineensis (oil palm) single nucleotide polymorphism (SNP) in genomic region adjacent to shatterproof1 (SHELL) shell thickness gene
agactttcgatttgtatgaatgtcmagactttttgttggaaaccgatttg

SEQ ID NO: 231 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctttttgttggaaaccgatttggtygaagctcccgaccaaagaatatcta

SEQ ID NO: 232 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatatcatgacaggaaggaggattkacagtatatttttctcagttgcaag

SEQ ID NO: 233 - DNA, 50 bp, Artificial Sequence
  synthetic Elaeis guineensis (oil palm) single nucleotide polymorphism (SNP) in genomic region adjacent to shatterproof1 (SHELL) shell thickness gene
atatttttctcagttgcaagctttyactcctttgttggacacatgtagtc

SEQ ID NO: 234 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtaggaatttgacaacttacatcgratacttgctcaagtttcacctcttc

SEQ ID NO: 235 - DNA, 50 bp, Artificial Sequence
  synthetic Elaeis guineensis (oil palm) single nucleotide polymorphism (SNP) in genomic region adjacent to shatterproof1 (SHELL) shell thickness gene
taagtttgctaactctctttgggayctttgtgtgcctctcaaattaagtt

SEQ ID NO: 236 - DNA, 50 bp, Artificial Sequence
  synthetic Elaeis guineensis (oil palm) single nucleotide polymorphism (SNP) in genomic region adjacent to shatterproof1 (SHELL) shell thickness gene
cttcttcggaagaagactggaaaaratctaggtggttgtgtgctttgtgg

SEQ ID NO: 237 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggaaaaaatctaggtggttgtgtgytttgtggccatggagaagagtcagt

SEQ ID NO: 238 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctcaacttgttttttcttctcatcyatctagaaagctgtttgttccttac

SEQ ID NO: 239 - DNA, 50 bp, Artificial Sequence
  synthetic Elaeis guineensis (oil palm) single nucleotide polymorphism (SNP) in genomic region adjacent to shatterproof1 (SHELL) shell thickness gene
catctagaaagctgtttgttccttrcttgggatactacaccgacagtctt

SEQ ID NO: 240 - DNA, 50 bp, Artificial Sequence
  synthetic Elaeis guineensis (oil palm) single nucleotide polymorphism (SNP) in genomic region adjacent to shatterproof1 (SHELL) shell thickness gene
acagtcttcctttgaggatcaatgyctttcatggagaagaaggaccttct

SEQ ID NO: 241 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagaaggaccttctcaaaatatttrcaaccaattattttgatgctatact

SEQ ID NO: 242 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccaaggatgcttgctgatgactgawatggtgaacaatgcaaacaaatgag

SEQ ID NO: 243 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaaggggcaaatggatatgacattmccacttatgcagatgggttctctaa

SEQ ID NO: 244 - DNA, 50 bp, Artificial Sequence
  synthetic Elaeis guineensis (oil palm) single nucleotide polymorphism (SNP) in genomic region adjacent to shatterproof1 (SHELL) shell thickness gene
agatgaaaaattcagaatagccttmcaggtttacgtgacttcagtaaact

SEQ ID NO: 245 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttcagtaaactaaaaacagtttgcrgctatccaaaaagcgaaccaaatgg

SEQ ID NO: 246 - DNA, 50 bp, Artificial Sequence
  synthetic Elaeis guineensis (oil palm) single nucleotide polymorphism (SNP) in genomic region adjacent to shatterproof1 (SHELL) shell thickness gene
gatgagaacaacatctttagtttcyctattcaatagtttcgatcccaagg

SEQ ID NO: 247 - DNA, 50 bp, Artificial Sequence
  synthetic Elaeis guineensis (oil palm) single nucleotide polymorphism (SNP) in genomic region adjacent to shatterproof1 (SHELL) shell thickness gene
atcctcagtgattgcagaccagctwgtgagcatttgaataattcttagaa

SEQ ID NO: 248 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttgaataattcttagaatcagggtytttgctgttagagcttcaaacttga

SEQ ID NO: 249 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatcttcagccgaagatgaggtatmcaaaatacctagcttttgagtgatt

SEQ ID NO: 250 - DNA, 50 bp, Artificial Sequence
  synthetic Elaeis guineensis (oil palm) single nucleotide polymorphism (SNP) in genomic region adjacent to shatterproof1 (SHELL) shell thickness gene
atagatgcagatggtgaaaagatgscttatggattctggatgtaaacaac

SEQ ID NO: 251 - DNA, 50 bp, Artificial Sequence
  synthetic Elaeis guineensis (oil palm) single nucleotide polymorphism (SNP) in genomic region adjacent to shatterproof1 (SHELL) shell thickness gene
agatggcttatggattctggatgtwaacaacacattggacaaacatgaga

SEQ ID NO: 252 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctgtagtaaggattttgttgtttwgcagcaaccaagtaaaaattttaat

SEQ ID NO: 253 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttttctttgcaaagatagacctgakactgccgtcactgaagaattgataa

SEQ ID NO: 254 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgcaaagatagacctgatactgccrtcactgaagaattgataatattttc

SEQ ID NO: 255 - DNA, 50 bp, Artificial Sequence
  synthetic Elaeis guineensis (oil palm) single nucleotide polymorphism (SNP) in genomic region adjacent to shatterproof1 (SHELL) shell thickness gene
gatactgccgtcactgaagaattgwtaatattttctaacagagaattttc

SEQ ID NO: 256 - DNA, 50 bp, Artificial Sequence
  synthetic Elaeis guineensis (oil palm) single nucleotide polymorphism (SNP) in genomic region adjacent to shatterproof1 (SHELL) shell thickness gene
taaaagatttcctccatgttcaaakatatatcttccctgaaagtcatctc

SEQ ID NO: 257 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaaaagatgaaaaagaattgaaaawttggatttcagtggcataattccaa

SEQ ID NO: 258 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggatttcagtggcataattccaagycattggtcatccaaaatgagatatt

SEQ ID NO: 259 - DNA, 50 bp, Artificial Sequence
  synthetic Elaeis guineensis (oil palm) single nucleotide polymorphism (SNP) in genomic region adjacent to shatterproof1 (SHELL) shell thickness gene
cattgcccagattaaaataaatgcyttgatggaagatcatgcctgttttc

SEQ ID NO: 260 - DNA, 50 bp, Artificial Sequence
  synthetic Elaeis guineensis (oil palm) single nucleotide polymorphism (SNP) in genomic region adjacent to shatterproof1 (SHELL) shell thickness gene
agcccttccttttgttctgtttagsagtctgttatgatagtgcggctgtg

SEQ ID NO: 261 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggaagacatctaatatattggtatmctactgagaacgtgattaataagag

SEQ ID NO: 262 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagtggaagtcccaggtaagtagtrggcaatgttgatagcttacaaccaa

SEQ ID NO: 263 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtggaagtcccaggtaagtagtggrcaatgttgatagcttacaaccaata

SEQ ID NO: 264 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttgtatcccaaaagtgctggtaaartgatattggaaatccctctggtcct

SEQ ID NO: 265 - DNA, 50 bp, Artificial Sequence
  synthetic Elaeis guineensis (oil palm) single nucleotide polymorphism (SNP) in genomic region adjacent to shatterproof1 (SHELL) shell thickness gene
atccctctggtcctggtgatttatmcttggccatactgaaaagggcgttt

SEQ ID NO: 266 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggcatagcaagctgaaaaaatttgrcaacagaagtttaatttattttata

SEQ ID NO: 267 - DNA, 50 bp, Artificial Sequence
  synthetic Elaeis guineensis (oil palm) single nucleotide polymorphism (SNP) in genomic region adjacent to shatterproof1 (SHELL) shell thickness gene
cagaagtttaatttattttataatyatggatttgtagttattcataaatg

SEQ ID NO: 268 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatcatggatttgtagttattcatraatgttgagattcgggttagtactt

SEQ ID NO: 269 - DNA, 50 bp, Artificial Sequence
  synthetic Elaeis guineensis (oil palm) single nucleotide polymorphism (SNP) in genomic region adjacent to shatterproof1 (SHELL) shell thickness gene
gttattcataaatgttgagattcgrgttagtacttacttttggatttaga

SEQ ID NO: 270 - DNA, 50 bp, Artificial Sequence
  synthetic Elaeis guineensis (oil palm) single nucleotide polymorphism (SNP) in genomic region adjacent to shatterproof1 (SHELL) shell thickness gene
atgttgagattcgggttagtacttrcttttggatttagatgctctgaacc

SEQ ID NO: 271 - DNA, 50 bp, Artificial Sequence
  synthetic Elaeis guineensis (oil palm) single nucleotide polymorphism (SNP) in genomic region adjacent to shatterproof1 (SHELL) shell thickness gene
cccatattggttcgattatttgatraataatagaattgaatctttttatt

SEQ ID NO: 272 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatatgggttcagagcatctaaatycaaaagtaagtactaacccgaatct

SEQ ID NO: 273 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatttggtgtagattgccgatgatyctcccttggtcctctatccaagcga

SEQ ID NO: 274 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgaaaaaatttggtatttttgtccscatattttaaccaatttgctctgga

SEQ ID NO: 275 - DNA, 50 bp, Artificial Sequence
  synthetic Elaeis guineensis (oil palm) single nucleotide polymorphism (SNP) in genomic region adjacent to shatterproof1 (SHELL) shell thickness gene
aacttgctctgattccaacttaaayttctctctttggctcttctcctcgt

SEQ ID NO: 276 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctcccatcttttctattacttttcygcctttactttgtggatcaacactt

SEQ ID NO: 277 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgagcaaccttctgtaaataccttrgacttcaataaaaaccggatggcag

SEQ ID NO: 278 - DNA, 50 bp, Artificial Sequence
  synthetic Elaeis guineensis (oil palm) single nucleotide polymorphism (SNP) in genomic region adjacent to shatterproof1 (SHELL) shell thickness gene
ataaaaaccggatggcagaattctvcagcctcccttatcctcaaacaaaa

SEQ ID NO: 279 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaaaccggatggcagaattctacwgcctcccttatcctcaaacaaaaaa

SEQ ID NO: 280 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctacagcctcccttatcctcaaamaaaaaaaaaaatgaagaaaggctag

SEQ ID NO: 281 - DNA, 50 bp, Artificial Sequence
  synthetic Elaeis guineensis (oil palm) single nucleotide polymorphism (SNP) in genomic region adjacent to shatterproof1 (SHELL) shell thickness gene
actgggatagctcagcttttttatyttttacatcaccattctttccctct

SEQ ID NO: 282 - DNA, 50 bp, Artificial Sequence
  synthetic Elaeis guineensis (oil palm) single nucleotide polymorphism (SNP) in genomic region adjacent to shatterproof1 (SHELL) shell thickness gene
agcttttttattttttacatcaccmttctttccctctgttagatggcttc

SEQ ID NO: 283 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctcactttgcagtagtcaaaataawttttgatagcttagttaagcaagga

SEQ ID NO: 284 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctatcagaataaataaaacttctaytcctattgcaggttggtacttgggc

SEQ ID NO: 285 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatccaacagattgactagctggcyatgcttgtgacttcaatcctttgga

SEQ ID NO: 286 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctttcactctatatgccaaagatmttgcctttttaatgactatattcat

SEQ ID NO: 287 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccactctttattgcagatgggctgygtgttatggaatatatattgcagat

SEQ ID NO: 288 - DNA, 50 bp, Artificial Sequence
  synthetic Elaeis guineensis (oil palm) single nucleotide polymorphism (SNP) in genomic region adjacent to shatterproof1 (SHELL) shell thickness gene
tattacatggtcctaattttacctwatttatgttcgttatactttcagca

SEQ ID NO: 289 - DNA, 50 bp, Artificial Sequence
  synthetic Elaeis guineensis (oil palm) single nucleotide polymorphism (SNP) in genomic region adjacent to shatterproof1 (SHELL) shell thickness gene
tccgcattataccaaatcagcttgmcaatcgttcgacatttattcttatt

SEQ ID NO: 290 - DNA, 50 bp, Artificial Sequence
  synthetic Elaeis guineensis (oil palm) single nucleotide polymorphism (SNP) in genomic region adjacent to shatterproof1 (SHELL) shell thickness gene
cgttcgacatttattcttattgcgstgttgagcaacttgtctcatattta

SEQ ID NO: 291 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttattcttattgcgctgttgagcarcttgtctcatatttatcttgctgca

SEQ ID NO: 292 - DNA, 50 bp, Artificial Sequence
  synthetic Elaeis guineensis (oil palm) single nucleotide polymorphism (SNP) in genomic region adjacent to shatterproof1 (SHELL) shell thickness gene
taatttttagcttatctagtgtcakcattctacgtttacatgtatgcact

SEQ ID NO: 293 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctctctctctgtatgtgtgtgtgygcgcgtgcgcgcgcgcatgcaatcc

SEQ ID NO: 294 - DNA, 50 bp, Artificial Sequence
  synthetic Elaeis guineensis (oil palm) single nucleotide polymorphism (SNP) in genomic region adjacent to shatterproof1 (SHELL) shell thickness gene
agatggaccatggagactgttcccwctctttcccctattcatgttcgata

SEQ ID NO: 295 - DNA, 50 bp, Artificial Sequence
  synthetic Elaeis guineensis (oil palm) single nucleotide polymorphism (SNP) in genomic region adjacent to shatterproof1 (SHELL) shell thickness gene
atagttatttatctgtcatcccatytggtggttctgtcagattaaacacc

SEQ ID NO: 296 - DNA, 50 bp, Artificial Sequence
  synthetic Elaeis guineensis (oil palm) single nucleotide polymorphism (SNP) in genomic region adjacent to shatterproof1 (SHELL) shell thickness gene
gattctgtctataaagcatggatayggatgtgacacgatacagatgtgcc

SEQ ID NO: 297 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtgacacgatacagatgtgccgatrtgacaagtttggagaagtatgttac

SEQ ID NO: 298 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatgttttaaagagtgatagcacgyattatttgataaacatagagtgata

SEQ ID NO: 299 - DNA, 50 bp, Artificial Sequence
  synthetic Elaeis guineensis (oil palm) single nucleotide polymorphism (SNP) in genomic region adjacent to shatterproof1 (SHELL) shell thickness gene
atttgaagttgagcttgaccagacycaggcttgattaacgtcagttaatc

SEQ ID NO: 300 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttgcttttgagctctgactgatatkcttatttctatttgaagggtttcat

SEQ ID NO: 301 - DNA, 50 bp, Artificial Sequence
  synthetic Elaeis guineensis (oil palm) single nucleotide polymorphism (SNP) in genomic region adjacent to shatterproof1 (SHELL) shell thickness gene
agctctgactaggtgcaaacaaaakttatttattccaaatgcctgtgctt

SEQ ID NO: 302 - DNA, 50 bp, Artificial Sequence
  synthetic Elaeis guineensis (oil palm) single nucleotide polymorphism (SNP) in genomic region adjacent to shatterproof1 (SHELL) shell thickness gene
tacacatagtagtctgcctaaaagyatcatgggctttgccagtataatgg

SEQ ID NO: 303 - DNA, 50 bp, Artificial Sequence
  synthetic Elaeis guineensis (oil palm) single nucleotide polymorphism (SNP) in genomic region adjacent to shatterproof1 (SHELL) shell thickness gene
catgtgctagtatattaatgaagarcagatggtctcatgcaggtggcgaa

SEQ ID NO: 304 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctgaaccgggcctccagtggcttgkcaaaaggagataaacatttggctat

SEQ ID NO: 305 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaaccgggcctccagtggcttggcmaaaggagataaacatttggctatga

SEQ ID NO: 306 - DNA, 50 bp, Artificial Sequence
  synthetic Elaeis guineensis (oil palm) single nucleotide polymorphism (SNP) in genomic region adjacent to shatterproof1 (SHELL) shell thickness gene
caacaaaaataaaaataaaaaaatmaaataaaataagatccttgaattca

SEQ ID NO: 307 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaataaaaataaaaaaataaaatmaaataagatccttgaattcagctgc

SEQ ID NO: 308 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgctgtcagagtccattctactcawcaaggaaattacagtagatgaatct

SEQ ID NO: 309 - DNA, 50 bp, Artificial Sequence
  synthetic Elaeis guineensis (oil palm) single nucleotide polymorphism (SNP) in genomic region adjacent to shatterproof1 (SHELL) shell thickness gene
attctactcaacaaggaaattacartagatgaatctcctctccatattgc

SEQ ID NO: 310 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctccatattgcagatgcctttcaarcccgtgtgacaatcataatcccttt

SEQ ID NO: 311 - DNA, 50 bp, Artificial Sequence
  synthetic Elaeis guineensis (oil palm) single nucleotide polymorphism (SNP) in genomic region adjacent to shatterproof1 (SHELL) shell thickness gene
agatgcctttcaaacccgtgtgacmatcataatccctttccaagcaacat

SEQ ID NO: 312 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccggccaccactgtaacagctccayccatatttctaatcatataaattag

SEQ ID NO: 313 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctaagagttaagtcatctataatgkgggatttggtgtaattgaaggagga

SEQ ID NO: 314 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggaaaatgcaagagtgcataaaaaygtcataaagatgataattgaggtgg

SEQ ID NO: 315 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagatgataattgaggtggaaattyttttgtagagaggttgatgctgttg

SEQ ID NO: 316 - DNA, 50 bp, Artificial Sequence
  synthetic Elaeis guineensis (oil palm) single nucleotide polymorphism (SNP) in genomic region adjacent to shatterproof1 (SHELL) shell thickness gene
actctttggttacgtggccttctamaaggctatcgaaagatgtgtctcga

SEQ ID NO: 317 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcattttctggtcaggctgaaatgycaatgccctcagttgtttcttcttt

SEQ ID NO: 318 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagctaagcgccatatgtttccttyctggatgaacaaaagtactggaaaa

SEQ ID NO: 319 - DNA, 50 bp, Artificial Sequence
  synthetic Elaeis guineensis (oil palm) single nucleotide polymorphism (SNP) in genomic region adjacent to shatterproof1 (SHELL) shell thickness gene
catcttgcttcggcttccggctcawttctgaatactgcccccccatcagc

SEQ ID NO: 320 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcaaaatctcctgccacagattagwtgaagaatctgctagggcactacta

SEQ ID NO: 321 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctatcaaaactgcttaccccatcragcttctcagttgcaactaacaagc

SEQ ID NO: 322 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttcaagatacaaggatggacaagaktattctgaagctaactaaatgatca

SEQ ID NO: 323 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaacttagcctcttatcattatatsaaatgccaaacttagcctcgccgtt

SEQ ID NO: 324 - DNA, 50 bp, Artificial Sequence
  synthetic Elaeis guineensis (oil palm) single nucleotide polymorphism (SNP) in genomic region adjacent to shatterproof1 (SHELL) shell thickness gene
gattctctaatggaatgatatgctwctctatttcgactagtcaactcacc

SEQ ID NO: 325 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaaacaagtacaattaccagtacytaatcaattcaagagtacatagcat

SEQ ID NO: 326 - DNA, 50 bp, Artificial Sequence
  synthetic Elaeis guineensis (oil palm) single nucleotide polymorphism (SNP) in genomic region adjacent to shatterproof1 (SHELL) shell thickness gene
acagtagttagaaattaaaaaagtrcaattctggatgctaggtcatttct

SEQ ID NO: 327 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaagtgcaattctggatgctaggtyatttctgatgtttgatgatttataa

SEQ ID NO: 328 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtgcatatataaatttttaaacaamacttagcgaaaatgaaattaagaag

SEQ ID NO: 329 - DNA, 50 bp, Artificial Sequence
  synthetic Elaeis guineensis (oil palm) single nucleotide polymorphism (SNP) in genomic region adjacent to shatterproof1 (SHELL) shell thickness gene
accttatcaaccttaactacctacrtttaaaatccttataagagcaggat

SEQ ID NO: 330 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttaagccccatactaatttctctrtgtcgtttataaacccataacctga

SEQ ID NO: 331 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttgaggtttatcctgtgtcacttcrtataggagattatgttatgcacaaa

SEQ ID NO: 332 - DNA, 50 bp, Artificial Sequence
  synthetic Elaeis guineensis (oil palm) single nucleotide polymorphism (SNP) in genomic region adjacent to shatterproof1 (SHELL) shell thickness gene
agcttaatcactatacctcaaggcrgatttataacaaatggattatcaga

SEQ ID NO: 333 - DNA, 50 bp, Artificial Sequence
  synthetic Elaeis guineensis (oil palm) single nucleotide polymorphism (SNP) in genomic region adjacent to shatterproof1 (SHELL) shell thickness gene
aacaccaaaaataaaccatgggaaraaggcagcagcatctacagcctcaa

SEQ ID NO: 334 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttatgcatatctaggtctttgattrtacaataacctataaagtatcatag

SEQ ID NO: 335 - DNA, 50 bp, Artificial Sequence
  synthetic Elaeis guineensis (oil palm) single nucleotide polymorphism (SNP) in genomic region adjacent to shatterproof1 (SHELL) shell thickness gene
tataaagtatcatagaagtcccaamatcatgaattgaattgtctacgagt

SEQ ID NO: 336 - DNA, 50 bp, Artificial Sequence
  synthetic Elaeis guineensis (oil palm) single nucleotide polymorphism (SNP) in genomic region adjacent to shatterproof1 (SHELL) shell thickness gene
cccagtttttgtgctaactgcaaaraaaggaaatgctccctgatcctcca

SEQ ID NO: 337 - DNA, 50 bp, Artificial Sequence
  synthetic Elaeis guineensis (oil palm) single nucleotide polymorphism (SNP) in genomic region adjacent to shatterproof1 (SHELL) shell thickness gene
atagctagacatttggcgatctatrgtcggacttgaaatcttattttgac

SEQ ID NO: 338 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaacagtcttatcggctgttaaagkggcatgatgctgtgctcctaacaat

SEQ ID NO: 339 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtactcacacatttaaagagaagayaagatggggaaatatgagaggaagt

SEQ ID NO: 340 - DNA, 50 bp, Artificial Sequence
  synthetic Elaeis guineensis (oil palm) single nucleotide polymorphism (SNP) in genomic region adjacent to shatterproof1 (SHELL) shell thickness gene
gagagataagagagatagggtggasaagagtagagatacaaagccacttg

SEQ ID NO: 341 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaaaagaagaataaaagggagacragagagggataggaggtgagagaga

SEQ ID NO: 342 - DNA, 50 bp, Artificial Sequence
  synthetic Elaeis guineensis (oil palm) single nucleotide polymorphism (SNP) in genomic region adjacent to shatterproof1 (SHELL) shell thickness gene
acccctatttcgaattggagttcaraggtcctcctccggcctcagccgcc

SEQ ID NO: 343 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcctccggcctcagccgccctccgytcccttgacgctggctcgccggttg

SEQ ID NO: 344 - DNA, 50 bp, Artificial Sequence
  synthetic Elaeis guineensis (oil palm) single nucleotide polymorphism (SNP) in genomic region adjacent to shatterproof1 (SHELL) shell thickness gene
catctgaaggcctccgatgatccartgaggtctcccccgcttttcttccc

SEQ ID NO: 345 - DNA, 50 bp, Artificial Sequence
  synthetic Elaeis guineensis (oil palm) single nucleotide polymorphism (SNP) in genomic region adjacent to shatterproof1 (SHELL) shell thickness gene
cgatgatccaatgaggtctccccckcttttcttccctccctccaccctta

SEQ ID NO: 346 - DNA, 50 bp, Artificial Sequence
  synthetic Elaeis guineensis (oil palm) single nucleotide polymorphism (SNP) in genomic region adjacent to shatterproof1 (SHELL) shell thickness gene
cttccctccctccacccttagcaasctcagaaagagctccgacagccacc

SEQ ID NO: 347 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcgatatggttcgacatggcctgcrtcgtccgatttgggatagttcagcg

SEQ ID NO: 348 - DNA, 50 bp, Artificial Sequence
  synthetic Elaeis guineensis (oil palm) single nucleotide polymorphism (SNP) in genomic region adjacent to shatterproof1 (SHELL) shell thickness gene
atgatatcaaacatggtggactctraagtatttcaaggaaaagaaaaata

SEQ ID NO: 349 - DNA, 50 bp, Artificial Sequence
  synthetic Elaeis guineensis (oil palm) single nucleotide polymorphism (SNP) in genomic region adjacent to shatterproof1 (SHELL) shell thickness gene
agtatttcaaggaaaagaaaaatawagagaaattcaccaaatcttgaatg

SEQ ID NO: 350 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttcaaatagttttcaagcaaggtawgacactagcaagaagaatctcgcaa

SEQ ID NO: 351 - DNA, 50 bp, Artificial Sequence
  synthetic Elaeis guineensis (oil palm) single nucleotide polymorphism (SNP) in genomic region adjacent to shatterproof1 (SHELL) shell thickness gene
cgggtcttgaattaagcttttaatsaactgcttaaatgcccaaaatggat

SEQ ID NO: 352 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctcaacgccaaaccactgcagcacygtgccgaagtagtttgtccaggttg

SEQ ID NO: 353 - DNA, 50 bp, Artificial Sequence
  synthetic Elaeis guineensis (oil palm) single nucleotide polymorphism (SNP) in genomic region adjacent to shatterproof1 (SHELL) shell thickness gene
agtaaagatataactgttaaaagaycagacaagtttcacggtaattctat

SEQ ID NO: 354 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtttccgatggggagcgagaaagargccagggattgggaagctacaagag

SEQ ID NO: 355 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggattgggaagctacaagagcgagytaccggagtggggaggaaaccttgg

SEQ ID NO: 356 - DNA, 50 bp, Artificial Sequence
  synthetic Elaeis guineensis (oil palm) single nucleotide polymorphism (SNP) in genomic region adjacent to shatterproof1 (SHELL) shell thickness gene
gattgggaagctacaagagcgagtkaccggagtggggaggaaaccttggg

SEQ ID NO: 357 - DNA, 50 bp, Artificial Sequence
  synthetic Elaeis guineensis (oil palm) single nucleotide polymorphism (SNP) in genomic region adjacent to shatterproof1 (SHELL) shell thickness gene
tactatatttagttggaggtgatcrtatatagaaatatgataaaatttat

SEQ ID NO: 358 - DNA, 50 bp, Artificial Sequence
  synthetic Elaeis guineensis (oil palm) single nucleotide polymorphism (SNP) in genomic region adjacent to shatterproof1 (SHELL) shell thickness gene
gataaaatttataaatatatttttyaatataaaataattttaaaaaaatt

SEQ ID NO: 359 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttaaaaaaattatacagatatctcyttaagtttatttcaatttcatttat

SEQ ID NO: 360 - DNA, 50 bp, Artificial Sequence
  synthetic Elaeis guineensis (oil palm) single nucleotide polymorphism (SNP) in genomic region adjacent to shatterproof1 (SHELL) shell thickness gene
taaatttaaatcgtctcaattagaycttccaaattatcgaagtgtatcga

SEQ ID NO: 361 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttatcgaagtgtatcgatgtgctcyttccgttcatcttcgttaaccaaat

SEQ ID NO: 362 - DNA, 50 bp, Artificial Sequence
  synthetic Elaeis guineensis (oil palm) single nucleotide polymorphism (SNP) in genomic region adjacent to shatterproof1 (SHELL) shell thickness gene
atttttttaaaataataaaaatatycttgatttcaattctcagtcgagca

SEQ ID NO: 363 - DNA, 50 bp, Artificial Sequence
  synthetic Elaeis guineensis (oil palm) single nucleotide polymorphism (SNP) in genomic region adjacent to shatterproof1 (SHELL) shell thickness gene
cgagcattagccaaagcgtcaaaargtaaaatcacatgcctcacgtgagc

SEQ ID NO: 364 - DNA, 50 bp, Artificial Sequence
  synthetic Elaeis guineensis (oil palm) single nucleotide polymorphism (SNP) in genomic region adjacent to shatterproof1 (SHELL) shell thickness gene
caaaaggtaaaatcacatgcctcaygtgagccattattttggatgcccta

SEQ ID NO: 365 - DNA, 50 bp, Artificial Sequence
  synthetic Elaeis guineensis (oil palm) single nucleotide polymorphism (SNP) in genomic region adjacent to shatterproof1 (SHELL) shell thickness gene
gagagagatcttcgatcaagctagycgtggtagagaaggagtcgccatgt

SEQ ID NO: 366 - DNA, 50 bp, Artificial Sequence
  synthetic Elaeis guineensis (oil palm) single nucleotide polymorphism (SNP) in genomic region adjacent to shatterproof1 (SHELL) shell thickness gene
agatcttcgatcaagctagccgtgrtagagaaggagtcgccatgtacgcc

SEQ ID NO: 367 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccgcaggtggagaagaaaaaattcrtgaaagaaaaagaaggttaccgata

SEQ ID NO: 368 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgaaagaaaaagaaggttaccgatrgagaaaaaagcaatgaagggtttcc

SEQ ID NO: 369 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtggaaccagattgctactgagaayctttgggaccaccgcaaatcctggt

SEQ ID NO: 370 - DNA, 50 bp, Artificial Sequence
  synthetic Elaeis guineensis (oil palm) single nucleotide polymorphism (SNP) in genomic region adjacent to shatterproof1 (SHELL) shell thickness gene
accagattgctactgagaacctttrggaccaccgcaaatcctggtcggca

SEQ ID NO: 371 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctttgggaccaccgcaaatcctggycggcatttctttagatgcagaatgt

SEQ ID NO: 372 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgtttaacttcgaattgtttgtcargtaaatgggggctctgggttcttcc

SEQ ID NO: 373 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctggattgttatgcttttttatatwatcgattttctattttaaatatact

SEQ ID NO: 374 - DNA, 50 bp, Artificial Sequence
  synthetic Elaeis guineensis (oil palm) single nucleotide polymorphism (SNP) in genomic region adjacent to shatterproof1 (SHELL) shell thickness gene
aattctttatgaaatgaaaaaaaawttctctagttgttagcaatgatggt

SEQ ID NO: 375 - DNA, 50 bp, Artificial Sequence
  synthetic Elaeis guineensis (oil palm) single nucleotide polymorphism (SNP) in genomic region adjacent to shatterproof1 (SHELL) shell thickness gene
agtgctacattgttaatggtacagyatacttataagtttcgatgaacacc

SEQ ID NO: 376 - DNA, 50 bp, Artificial Sequence
  synthetic Elaeis guineensis (oil palm) single nucleotide polymorphism (SNP) in genomic region adjacent to shatterproof1 (SHELL) shell thickness gene
attgttaatggtacagtatacttayaagtttcgatgaacacccctgatat

SEQ ID NO: 377 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatacttataagtttcgatgaacayccctgatattttattgctattacgc

SEQ ID NO: 378 - DNA, 50 bp, Artificial Sequence
  synthetic Elaeis guineensis (oil palm) single nucleotide polymorphism (SNP) in genomic region adjacent to shatterproof1 (SHELL) shell thickness gene
cctataagaattttttttgtcacaygcatcaaaatatcacaacttttaat

SEQ ID NO: 379 - DNA, 50 bp, Artificial Sequence
  synthetic Elaeis guineensis (oil palm) single nucleotide polymorphism (SNP) in genomic region adjacent to shatterproof1 (SHELL) shell thickness gene
tacaaaaaatataaaaaatttgackgacaaatcacaatgtatcagtgcat

SEQ ID NO: 380 - DNA, 50 bp, Artificial Sequence
  synthetic Elaeis guineensis (oil palm) single nucleotide polymorphism (SNP) in genomic region adjacent to shatterproof1 (SHELL) shell thickness gene
acatacaaaatacaatgaagtcccraatatatctaaaatggccttgatac

SEQ ID NO: 381 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctgagacaaataacctactgctgrctggaagggagctggttgggagaaa

SEQ ID NO: 382 - DNA, 50 bp, Artificial Sequence
  synthetic Elaeis guineensis (oil palm) single nucleotide polymorphism (SNP) in genomic region adjacent to shatterproof1 (SHELL) shell thickness gene
gacaaataacctactgctgactggragggagctggttgggagaaagaatg

SEQ ID NO: 383 - DNA, 50 bp, Artificial Sequence
  synthetic Elaeis guineensis (oil palm) single nucleotide polymorphism (SNP) in genomic region adjacent to shatterproof1 (SHELL) shell thickness gene
tagtagcttctggctgggaggacaratgctgggagggagctggctaggag

SEQ ID NO: 384 - DNA, 50 bp, Artificial Sequence
  synthetic Elaeis guineensis (oil palm) single nucleotide polymorphism (SNP) in genomic region adjacent to shatterproof1 (SHELL) shell thickness gene
gctgtaaggacagaggttgggaggraactggttgggagaatgtacccact

SEQ ID NO: 385 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggacagaggttgggaggaaactggytgggagaatgtacccactgaagttg

SEQ ID NO: 386 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttggtctataaaaaaatacaaaawgataagtaaatatttattaatttta

SEQ ID NO: 387 - DNA, 50 bp, Artificial Sequence
  synthetic Elaeis guineensis (oil palm) single nucleotide polymorphism (SNP) in genomic region adjacent to shatterproof1 (SHELL) shell thickness gene
taaatatttattaattttaatattraatataaatgtaccagtgatctctc

SEQ ID NO: 388 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcaagccctggagttatggacccaytgttgacaattcttgcaccttaagg

SEQ ID NO: 389 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagccctggagttatggacccattrttgacaattcttgcaccttaaggat

SEQ ID NO: 390 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcctatgttgctttagtgtaccatrtactaacaaaatattctgcttcctt

SEQ ID NO: 391 - DNA, 50 bp, Artificial Sequence
  synthetic Elaeis guineensis (oil palm) single nucleotide polymorphism (SNP) in genomic region adjacent to shatterproof1 (SHELL) shell thickness gene
atacataatagctattacagcatgrcagcatgggatgccagttaaatctt

SEQ ID NO: 392 - DNA, 50 bp, Artificial Sequence
  synthetic Elaeis guineensis (oil palm) single nucleotide polymorphism (SNP) in genomic region adjacent to shatterproof1 (SHELL) shell thickness gene
caacaaatctatcattgtgatgctyaatttcaattttgtagcctcctccc

SEQ ID NO: 393 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccatggcctctaactttgctttttycaatttcttttgaatcttaggacat

SEQ ID NO: 394 - DNA, 50 bp, Artificial Sequence
  synthetic Elaeis guineensis (oil palm) single nucleotide polymorphism (SNP) in genomic region adjacent to shatterproof1 (SHELL) shell thickness gene
caataatatacttgttgaatgactygcatatgttgttcaaaagcatgcta

SEQ ID NO: 395 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaagcatgctagacttccttctatygctgaaagcatgcctcgcccatagc

SEQ ID NO: 396 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcccatagctctggtggatgttgtygaagccactgccatgttgtctcatc

SEQ ID NO: 397 - DNA, 50 bp, Artificial Sequence
  synthetic Elaeis guineensis (oil palm) single nucleotide polymorphism (SNP) in genomic region adjacent to shatterproof1 (SHELL) shell thickness gene
ataacactcttgaaggtctccacargacccaataaaagaattgaaaaaaa

SEQ ID NO: 398 - DNA, 50 bp, Artificial Sequence
  synthetic Elaeis guineensis (oil palm) single nucleotide polymorphism (SNP) in genomic region adjacent to shatterproof1 (SHELL) shell thickness gene
tccacaggacccaataaaagaattraaaaaaataaattacgtataaaatc

SEQ ID NO: 399 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagagaattgaacaagttttttaayaagataaataaaccttctgtctgtc

SEQ ID NO: 400 - DNA, 50 bp, Artificial Sequence
  synthetic Elaeis guineensis (oil palm) single nucleotide polymorphism (SNP) in genomic region adjacent to shatterproof1 (SHELL) shell thickness gene
taataagataaataaaccttctgtytgtcagacataaagatccatccatg

SEQ ID NO: 401 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctctacaacagcccatgcaacagraaaaatattttcatttctatccttc

SEQ ID NO: 402 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccaaaagagcccttcaagtggcaaytgtccaaaccaatgatagatctgca

SEQ ID NO: 403 - DNA, 50 bp, Artificial Sequence
  synthetic Elaeis guineensis (oil palm) single nucleotide polymorphism (SNP) in genomic region adjacent to shatterproof1 (SHELL) shell thickness gene
tagatctgcaacctttgataaagcyctgcttgtatgctgcaagacaacag

SEQ ID NO: 404 - DNA, 50 bp, Artificial Sequence
  synthetic Elaeis guineensis (oil palm) single nucleotide polymorphism (SNP) in genomic region adjacent to shatterproof1 (SHELL) shell thickness gene
aacagtataaccttctaaaaatggrctggctactctcatcgacctactaa

SEQ ID NO: 405 - DNA, 50 bp, Artificial Sequence
  synthetic Elaeis guineensis (oil palm) single nucleotide polymorphism (SNP) in genomic region adjacent to shatterproof1 (SHELL) shell thickness gene
cttctaaaaatgggctggctactcycatcgacctactaacatccaacaac

SEQ ID NO: 406 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccctgtggctgtcctaaataatctycaatgctctacttttggccctataa

SEQ ID NO: 407 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttatttgataggtaagctcgctctrtacagaaaaagtatgaatcttccac

SEQ ID NO: 408 - DNA, 50 bp, Artificial Sequence
  synthetic Elaeis guineensis (oil palm) single nucleotide polymorphism (SNP) in genomic region adjacent to shatterproof1 (SHELL) shell thickness gene
cctcctatatgctataaagccacarcactttcttaaactgtgtgacattc

SEQ ID NO: 409 - DNA, 50 bp, Artificial Sequence
  synthetic Elaeis guineensis (oil palm) single nucleotide polymorphism (SNP) in genomic region adjacent to shatterproof1 (SHELL) shell thickness gene
attgaattcaggatattcagaaccycgaataccagcatctgaatcactat

SEQ ID NO: 410 - DNA, 50 bp, Artificial Sequence
  synthetic Elaeis guineensis (oil palm) single nucleotide polymorphism (SNP) in genomic region adjacent to shatterproof1 (SHELL) shell thickness gene
taggctgctcctctccaaaaaaatyaactccctcatgaggtagagaatga

SEQ ID NO: 411 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggctgctcctctccaaaaaaatcarctccctcatgaggtagagaatgatg

SEQ ID NO: 412 - DNA, 50 bp, Artificial Sequence
  synthetic Elaeis guineensis (oil palm) single nucleotide polymorphism (SNP) in genomic region adjacent to shatterproof1 (SHELL) shell thickness gene
caggcaaccgtaggatttgaagtgrcagcttcaatccctttcaatttctt

SEQ ID NO: 413 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttttcattaccaatctctttacccragttcttggtgttgatgcattgtat

SEQ ID NO: 414 - DNA, 50 bp, Artificial Sequence
  synthetic Elaeis guineensis (oil palm) single nucleotide polymorphism (SNP) in genomic region adjacent to shatterproof1 (SHELL) shell thickness gene
atacacaccaacaagctttgtttgyctgtttcagataaaggaacatcacc

SEQ ID NO: 415 - DNA, 50 bp, Artificial Sequence
  synthetic Elaeis guineensis (oil palm) single nucleotide polymorphism (SNP) in genomic region adjacent to shatterproof1 (SHELL) shell thickness gene
caccagcatttgcttggtgctcaayatatacctcaaccatatcagcacct

SEQ ID NO: 416 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcatgacatcttaatttcctcaagycattttgtaatgtctgtcatggcat

SEQ ID NO: 417 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcaagccattttgtaatgtctgtcmtggcattaggtaataaaaatggtta

SEQ ID NO: 418 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctgtcatggcattaggtaataaaartggttacaatttgtgtatcctaact

SEQ ID NO: 419 - DNA, 50 bp, Artificial Sequence
  synthetic Elaeis guineensis (oil palm) single nucleotide polymorphism (SNP) in genomic region adjacent to shatterproof1 (SHELL) shell thickness gene
attaggtaataaaaatggttacaawttgtgtatcctaactagctcatcat

SEQ ID NO: 420 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttagatggtatttaaaagatctacyataatgaatttgtacagtaaataag

SEQ ID NO: 421 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagttagagtctatctctgcacaaygaataagagacatagaatactaaaa

SEQ ID NO: 422 - DNA, 50 bp, Artificial Sequence
  synthetic Elaeis guineensis (oil palm) single nucleotide polymorphism (SNP) in genomic region adjacent to shatterproof1 (SHELL) shell thickness gene
agaagagaatctgatctttttcttrataattgggttaatctgatataaca

SEQ ID NO: 423 - DNA, 50 bp, Artificial Sequence
  synthetic Elaeis guineensis (oil palm) single nucleotide polymorphism (SNP) in genomic region adjacent to shatterproof1 (SHELL) shell thickness gene
acatgtacaaaagataaaggacacwaaaaaatactaagttaatcagagtc

SEQ ID NO: 424 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtggatcctatctgtcatgctcacrtatatcaaaaataggaccacaaaat

SEQ ID NO: 425 - DNA, 50 bp, Artificial Sequence
  synthetic Elaeis guineensis (oil palm) single nucleotide polymorphism (SNP) in genomic region adjacent to shatterproof1 (SHELL) shell thickness gene
tggatcctatctgtcatgctcacgyatatcaaaaataggaccacaaaata

SEQ ID NO: 426 - DNA, 50 bp, Artificial Sequence
  synthetic Elaeis guineensis (oil palm) single nucleotide polymorphism (SNP) in genomic region adjacent to shatterproof1 (SHELL) shell thickness gene
caaaatatatgaggacaaagggacmacaaaaatcaaagaaaaaaatccta

SEQ ID NO: 427 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtatcggtttacaaccataaaatcytaaaactatcggttggccactaaag

SEQ ID NO: 428 - DNA, 50 bp, Artificial Sequence
  synthetic Elaeis guineensis (oil palm) single nucleotide polymorphism (SNP) in genomic region adjacent to shatterproof1 (SHELL) shell thickness gene
agatgtattatcggcaaaagaagayataaggctcatccacagataaaaat

SEQ ID NO: 429 - DNA, 50 bp, Artificial Sequence
  synthetic Elaeis guineensis (oil palm) single nucleotide polymorphism (SNP) in genomic region adjacent to shatterproof1 (SHELL) shell thickness gene
cacagataaaaataaggtattcaaraggctatcacgctcgtgcacaaggg

SEQ ID NO: 430 - DNA, 50 bp, Artificial Sequence
  synthetic Elaeis guineensis (oil palm) single nucleotide polymorphism (SNP) in genomic region adjacent to shatterproof1 (SHELL) shell thickness gene
taaaaataaggtattcaagaggctrtcacgctcgtgcacaagggaggaga

SEQ ID NO: 431 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggatagcattatcattttcaattartttttatataatgaatataatcaca

SEQ ID NO: 432 - DNA, 50 bp, Artificial Sequence
  synthetic Elaeis guineensis (oil palm) single nucleotide polymorphism (SNP) in genomic region adjacent to shatterproof1 (SHELL) shell thickness gene
atgaatataatcacataactctttrcataatgctatcttcatcttaattt

SEQ ID NO: 433 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaagctctttattgaataaatttrgatagacattaaaacaaatttaata

SEQ ID NO: 434 - DNA, 50 bp, Artificial Sequence
  synthetic Elaeis guineensis (oil palm) single nucleotide polymorphism (SNP) in genomic region adjacent to shatterproof1 (SHELL) shell thickness gene
gatagacattaaaacaaatttaatrattacatatgtagctttattgaaga

SEQ ID NO: 435 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgtagctttattgaagatatttctrtcaggtatagattatcatcatttag

SEQ ID NO: 436 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatttttttatcatttttttatttyattttttatactaaatattataatt

SEQ ID NO: 437 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgatcacatttatcaactttaaaamgtgattattttaggtatcaaaaatt

SEQ ID NO: 438 - DNA, 50 bp, Artificial Sequence
  synthetic Elaeis guineensis (oil palm) single nucleotide polymorphism (SNP) in genomic region adjacent to shatterproof1 (SHELL) shell thickness gene
atttaaggattgaaagacttcaccwttattttgtttttgatcaaagcttg

SEQ ID NO: 439 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttgactgattgaattggaaaccgrttatctatccaaaataatatgaaaa

SEQ ID NO: 440 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaaataatcaaaacttggtcaaayaggatgaatcggatgaaccaatcag

SEQ ID NO: 441 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtcctaaatctctccctctctcctycatcactggaatctagtgcctccca

SEQ ID NO: 442 - DNA, 50 bp, Artificial Sequence
  synthetic Elaeis guineensis (oil palm) single nucleotide polymorphism (SNP) in genomic region adjacent to shatterproof1 (SHELL) shell thickness gene
actggaatctagtgcctcccaactytgccctcgagagtttctccaaacct

SEQ ID NO: 443 - DNA, 50 bp, Artificial Sequence
  synthetic Elaeis guineensis (oil palm) single nucleotide polymorphism (SNP) in genomic region adjacent to shatterproof1 (SHELL) shell thickness gene
agcttctctcacacctagtctctarggttttgtggtgctcaaggcctttg

SEQ ID NO: 444 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctagggttttgtggtgctcaaggcytttggtggtggggaagatggagctg

SEQ ID NO: 445 - DNA, 50 bp, Artificial Sequence
  synthetic Elaeis guineensis (oil palm) single nucleotide polymorphism (SNP) in genomic region adjacent to shatterproof1 (SHELL) shell thickness gene
cactcatggtactcacctcaaggtyatctatattgggtcctttctcattt

SEQ ID NO: 446 - DNA, 50 bp, Artificial Sequence
  synthetic Elaeis guineensis (oil palm) single nucleotide polymorphism (SNP) in genomic region adjacent to shatterproof1 (SHELL) shell thickness gene
cgacaacaccactactatccaccayttcatcgctagccctccctccttcg

SEQ ID NO: 447 - DNA, 50 bp, Artificial Sequence
  synthetic Elaeis guineensis (oil palm) single nucleotide polymorphism (SNP) in genomic region adjacent to shatterproof1 (SHELL) shell thickness gene
tccttcgtcccttccaccctacaakgactaaacaagcctgctctattgac

SEQ ID NO: 448 - DNA, 50 bp, Artificial Sequence
  synthetic Elaeis guineensis (oil palm) single nucleotide polymorphism (SNP) in genomic region adjacent to shatterproof1 (SHELL) shell thickness gene
aggtggatagtgggggagcataagragcacttgagagtaataaaggagta

SEQ ID NO: 449 - DNA, 50 bp, Artificial Sequence
  synthetic Elaeis guineensis (oil palm) single nucleotide polymorphism (SNP) in genomic region adjacent to shatterproof1 (SHELL) shell thickness gene
gatagtgggggagcataagaagcayttgagagtaataaaggagtaaggag

SEQ ID NO: 450 - DNA, 50 bp, Artificial Sequence
  synthetic Elaeis guineensis (oil palm) single nucleotide polymorphism (SNP) in genomic region adjacent to shatterproof1 (SHELL) shell thickness gene
tactgcatgtgatagtggggagggrcatgtgagatatacaacggcattgg

SEQ ID NO: 451 - DNA, 50 bp, Artificial Sequence
  synthetic Elaeis guineensis (oil palm) single nucleotide polymorphism (SNP) in genomic region adjacent to shatterproof1 (SHELL) shell thickness gene
cattggtggatcaatcaaactgacrtgcaccaaccatgcgtgaagagtga

SEQ ID NO: 452 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtgaagagtgaggaaggatgctttycgagcatgtgagatgagggcaatta

SEQ ID NO: 453 - DNA, 50 bp, Artificial Sequence
  synthetic Elaeis guineensis (oil palm) single nucleotide polymorphism (SNP) in genomic region adjacent to shatterproof1 (SHELL) shell thickness gene
gagggcaattaaattggccaatcaratcgattagactggtcaacccaaga

SEQ ID NO: 454 - DNA, 50 bp, Artificial Sequence
  synthetic Elaeis guineensis (oil palm) single nucleotide polymorphism (SNP) in genomic region adjacent to shatterproof1 (SHELL) shell thickness gene
taacttgatggttcactatctaatycgattttaaaaatattactttttta

SEQ ID NO: 455 - DNA, 50 bp, Artificial Sequence
  synthetic Elaeis guineensis (oil palm) single nucleotide polymorphism (SNP) in genomic region adjacent to shatterproof1 (SHELL) shell thickness gene
atctaattcgattttaaaaatattrcttttttattatcttttatcgcact

SEQ ID NO: 456 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcaaaaatataacaggtatcatatwacaactccaatgaaaacaatgaaag

SEQ ID NO: 457 - DNA, 50 bp, Artificial Sequence
  synthetic Elaeis guineensis (oil palm) single nucleotide polymorphism (SNP) in genomic region adjacent to shatterproof1 (SHELL) shell thickness gene
attaatgcgcacatgagaagttcaygactcacaaatctcaggaatggtag

SEQ ID NO: 458 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatattattttggtatcaatgcaayaaatacaaatatacaatgaggagtc

SEQ ID NO: 459 - DNA, 50 bp, Artificial Sequence
  synthetic Elaeis guineensis (oil palm) single nucleotide polymorphism (SNP) in genomic region adjacent to shatterproof1 (SHELL) shell thickness gene
accttgaatggtagatattaaatayggataggccaaacagtggggtccat

SEQ ID NO: 460 - DNA, 50 bp, Artificial Sequence
  synthetic Elaeis guineensis (oil palm) single nucleotide polymorphism (SNP) in genomic region adjacent to shatterproof1 (SHELL) shell thickness gene
accacatgatgatcactggggccgytagttcattcgatcttgatagatcc

SEQ ID NO: 461 - DNA, 50 bp, Artificial Sequence
  synthetic Elaeis guineensis (oil palm) single nucleotide polymorphism (SNP) in genomic region adjacent to shatterproof1 (SHELL) shell thickness gene
agatccgatccgatctgaatcaatyaaatttaaaaattaaaaattaaaaa

SEQ ID NO: 462 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtgaatcaacacccacttaattgamatttcaaaagaatccccatgctaca

SEQ ID NO: 463 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaatccccatgctacaatggctcawggatacaaaatcaccacccgttgag

SEQ ID NO: 464 - DNA, 50 bp, Artificial Sequence
  synthetic Elaeis guineensis (oil palm) single nucleotide polymorphism (SNP) in genomic region adjacent to shatterproof1 (SHELL) shell thickness gene
gttccaacataaaacccatcaaacracgctgagttaccctccaattgccg

SEQ ID NO: 465 - DNA, 50 bp, Artificial Sequence
  synthetic Elaeis guineensis (oil palm) single nucleotide polymorphism (SNP) in genomic region adjacent to shatterproof1 (SHELL) shell thickness gene
agatgcctaatactcatcacctgtracaaccaaatttttgatgatatttg

SEQ ID NO: 466 - DNA, 50 bp, Artificial Sequence
  synthetic Elaeis guineensis (oil palm) single nucleotide polymorphism (SNP) in genomic region adjacent to shatterproof1 (SHELL) shell thickness gene
atgagaagaatattatgagaatagrtgcaaaaggcttttcacatggaatc

SEQ ID NO: 467 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcacatggaatctggagaatacttytatcaggaagatgtgaaaatagacc

SEQ ID NO: 468 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaacaaaatgccacaattttggtrtcatatactgagattatatgctttc

SEQ ID NO: 469 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgaattagactgacgtagaaaacawagtataagtgggtgcaaaggtggct

SEQ ID NO: 470 - DNA, 50 bp, Artificial Sequence
  synthetic Elaeis guineensis (oil palm) single nucleotide polymorphism (SNP) in genomic region adjacent to shatterproof1 (SHELL) shell thickness gene
agtataagtgggtgcaaaggtggcwatcttggtgccttaggaagtctttt

SEQ ID NO: 471 - DNA, 50 bp, Artificial Sequence
  synthetic Elaeis guineensis (oil palm) single nucleotide polymorphism (SNP) in genomic region adjacent to shatterproof1 (SHELL) shell thickness gene
agtgggtgcaaaggtggctatcttrgtgccttaggaagtcttttgctcaa

SEQ ID NO: 472 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcacaaaataggtgaacatcttcayatcccatgttccttcttcctgtgtg

SEQ ID NO: 473 - DNA, 50 bp, Artificial Sequence
  synthetic Elaeis guineensis (oil palm) single nucleotide polymorphism (SNP) in genomic region adjacent to shatterproof1 (SHELL) shell thickness gene
acatgagcatatgctcaccaaaggscaaccctatttttgtgtggtttcat

SEQ ID NO: 474 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtttcatgtgcactccatgcaaaaktcttggactttacacagggataggc

SEQ ID NO: 475 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgtgcactccatgcaaaagtcttgractttacacagggataggcatgctt

SEQ ID NO: 476 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttggtgccatctgcttttcccttcrtgttcttcattagcacaggcaccca

SEQ ID NO: 477 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaaaaaagacttaaagctccaccmtatcacaaatctccttagcttcaac

SEQ ID NO: 478 - DNA, 50 bp, Artificial Sequence
  synthetic Elaeis guineensis (oil palm) single nucleotide polymorphism (SNP) in genomic region adjacent to shatterproof1 (SHELL) shell thickness gene
attctttcttgttctagaccactcrtcactctatttctttgttttcatca

SEQ ID NO: 479 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctggctttactgaagaagtatctratccatacatatcaccattttgcaa

SEQ ID NO: 480 - DNA, 50 bp, Artificial Sequence
  synthetic Elaeis guineensis (oil palm) single nucleotide polymorphism (SNP) in genomic region adjacent to shatterproof1 (SHELL) shell thickness gene
catgggaagtgagtatatggtttcrttgaaagcgagaggagactttaaag

SEQ ID NO: 481 - DNA, 50 bp, Artificial Sequence
  synthetic Elaeis guineensis (oil palm) single nucleotide polymorphism (SNP) in genomic region adjacent to shatterproof1 (SHELL) shell thickness gene
agcgagaggagactttaaagacaamccaatgagatcatgacctgtcagct

SEQ ID NO: 482 - DNA, 50 bp, Artificial Sequence
  synthetic Elaeis guineensis (oil palm) single nucleotide polymorphism (SNP) in genomic region adjacent to shatterproof1 (SHELL) shell thickness gene
cctctgggtaataatgaaaacatcrgtctcattaatctcatatgctccat

SEQ ID NO: 483 - DNA, 50 bp, Artificial Sequence
  synthetic Elaeis guineensis (oil palm) single nucleotide polymorphism (SNP) in genomic region adjacent to shatterproof1 (SHELL) shell thickness gene
caagtaaacttttctaccttccaasaccttcaactgcggagggaaaggtg

SEQ ID NO: 484 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttgattaaaacatactcttgtggcwgaacaccttcaccagaggctctatc

SEQ ID NO: 485 - DNA, 50 bp, Artificial Sequence
  synthetic Elaeis guineensis (oil palm) single nucleotide polymorphism (SNP) in genomic region adjacent to shatterproof1 (SHELL) shell thickness gene
tggaattttgcaatatcactgtccratagaccaaagcttctcattatctc

SEQ ID NO: 486 - DNA, 50 bp, Artificial Sequence
  synthetic Elaeis guineensis (oil palm) single nucleotide polymorphism (SNP) in genomic region adjacent to shatterproof1 (SHELL) shell thickness gene
tagtagaatcctcctctgtggaagraaacacaggtggatttccaaactgc

SEQ ID NO: 487 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttgtcccgagccttgaacagctacmgataatctacaagaaatttcaacca

SEQ ID NO: 488 - DNA, 50 bp, Artificial Sequence
  synthetic Elaeis guineensis (oil palm) single nucleotide polymorphism (SNP) in genomic region adjacent to shatterproof1 (SHELL) shell thickness gene
caatagcctgacaaatacaataagmcccagccataataatgctttccctc

SEQ ID NO: 489 - DNA, 50 bp, Artificial Sequence
  synthetic Elaeis guineensis (oil palm) single nucleotide polymorphism (SNP) in genomic region adjacent to shatterproof1 (SHELL) shell thickness gene
atcaaaagatcaggctcgcaaacawgcttcggattgagaaaaccaataaa

SEQ ID NO: 490 - DNA, 50 bp, Artificial Sequence
  synthetic Elaeis guineensis (oil palm) single nucleotide polymorphism (SNP) in genomic region adjacent to shatterproof1 (SHELL) shell thickness gene
acctatcacgggtcaagaaaatccsgattgggtcactttggtctactatt

SEQ ID NO: 491 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctacaacaagtcaagtcatgatggkttgagctgcagtgaattgggtttgg

SEQ ID NO: 492 - DNA, 50 bp, Artificial Sequence
  synthetic Elaeis guineensis (oil palm) single nucleotide polymorphism (SNP) in genomic region adjacent to shatterproof1 (SHELL) shell thickness gene
caagtcatgatggtttgagctgcaktgaattgggtttggtttggttgcgt

SEQ ID NO: 493 - DNA, 50 bp, Artificial Sequence
  synthetic Elaeis guineensis (oil palm) single nucleotide polymorphism (SNP) in genomic region adjacent to shatterproof1 (SHELL) shell thickness gene
atttagcaacgtttatgttttgacycaatccggctcatcttgaccatgcc

SEQ ID NO: 494 - DNA, 50 bp, Artificial Sequence
  synthetic Elaeis guineensis (oil palm) single nucleotide polymorphism (SNP) in genomic region adjacent to shatterproof1 (SHELL) shell thickness gene
aacgtttatgttttgactcaatccrgctcatcttgaccatgccaccatga

SEQ ID NO: 495 - DNA, 50 bp, Artificial Sequence
  synthetic Elaeis guineensis (oil palm) single nucleotide polymorphism (SNP) in genomic region adjacent to shatterproof1 (SHELL) shell thickness gene
acgtttatgttttgactcaatccgrctcatcttgaccatgccaccatgat

SEQ ID NO: 496 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttgcccccttatatgaatcagatcwggcatccgagaatgtaatcaagttc

SEQ ID NO: 497 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagaaagaatagttcggaatgagartttgttccaaagttatgttggtccc

SEQ ID NO: 498 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttttagcccacttgtggtgtggaygaatgtttcttttagtagttgcatt

SEQ ID NO: 499 - DNA, 50 bp, Artificial Sequence
  synthetic Elaeis guineensis (oil palm) single nucleotide polymorphism (SNP) in genomic region adjacent to shatterproof1 (SHELL) shell thickness gene
atcttgagtataaaaggctcttacyctctttccaccttcgatccgacttc

SEQ ID NO: 500 - DNA, 50 bp, Artificial Sequence
  synthetic Elaeis guineensis (oil palm) single nucleotide polymorphism (SNP) in genomic region adjacent to shatterproof1 (SHELL) shell thickness gene
agccaaacctccttcggtttcctcytttgatttccttcttcgatcctcct

SEQ ID NO: 501 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagaagctgtactcatcagcactcractatcactaagggagcccaaatct

SEQ ID NO: 502 - DNA, 50 bp, Artificial Sequence
  synthetic Elaeis guineensis (oil palm) single nucleotide polymorphism (SNP) in genomic region adjacent to shatterproof1 (SHELL) shell thickness gene
actcgactatcactaagggagcccraatctatgccattttatttcttctt

SEQ ID NO: 503 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtattgcttggcacctcggtcactygagatctaggattttttttttctta

SEQ ID NO: 504 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcacctcggtcactcgagatctagrattttttttttcttattttaatggc

SEQ ID NO: 505 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttatttagtaaatagattaaacarattgagtcagatcagttaaacatgt

SEQ ID NO: 506 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtatttatcctcacccacagatttwgtgccgtcgaactttggtagctggc

SEQ ID NO: 507 - DNA, 50 bp, Artificial Sequence
  synthetic Elaeis guineensis (oil palm) single nucleotide polymorphism (SNP) in genomic region adjacent to shatterproof1 (SHELL) shell thickness gene
acaaacaaacccatggcatagggtrcactttgctctaaatcaccactcat

SEQ ID NO: 508 - DNA, 50 bp, Artificial Sequence
  synthetic Elaeis guineensis (oil palm) single nucleotide polymorphism (SNP) in genomic region adjacent to shatterproof1 (SHELL) shell thickness gene
aattaggtataattttctcaattgrttattgatttgaaaatttttaaaga

SEQ ID NO: 509 - DNA, 50 bp, Artificial Sequence
  synthetic Elaeis guineensis (oil palm) single nucleotide polymorphism (SNP) in genomic region adjacent to shatterproof1 (SHELL) shell thickness gene
gttgccatcgatagagaataatatyttaaattaattagtagtaaaaattc

SEQ ID NO: 510 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaataatattttaaattaattagtrgtaaaaattcaatctctcaattttt

SEQ ID NO: 511 - DNA, 50 bp, Artificial Sequence
  synthetic Elaeis guineensis (oil palm) single nucleotide polymorphism (SNP) in genomic region adjacent to shatterproof1 (SHELL) shell thickness gene
actcaactgattgttttaaaaaaawaataaattttatttaaaatctaaac

SEQ ID NO: 512 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccggaccagaagatcagcaaactgstcggcattgtacacgtttcgtgtat

SEQ ID NO: 513 - DNA, 50 bp, Artificial Sequence
  synthetic Elaeis guineensis (oil palm) single nucleotide polymorphism (SNP) in genomic region adjacent to shatterproof1 (SHELL) shell thickness gene
taacaataataggagaaaaatacawgaaaactggtgcacactgcaggcac

SEQ ID NO: 514 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgatgagacgaggggacaataaatscagtctacgaatgtattaaatggag

SEQ ID NO: 515 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggagaacttgctcttataccttggwattcgagactagaccttattttcct

SEQ ID NO: 516 - DNA, 50 bp, Artificial Sequence
  synthetic Elaeis guineensis (oil palm) single nucleotide polymorphism (SNP) in genomic region adjacent to shatterproof1 (SHELL) shell thickness gene
tataccttggaattcgagactagaycttattttcctttgaccaatgtagt

SEQ ID NO: 517 - DNA, 50 bp, Artificial Sequence
  synthetic Elaeis guineensis (oil palm) single nucleotide polymorphism (SNP) in genomic region adjacent to shatterproof1 (SHELL) shell thickness gene
atagaagatgaaaaattggtggatrttagagagtattattaggcataaac

SEQ ID NO: 518 - DNA, 50 bp, Artificial Sequence
  synthetic Elaeis guineensis (oil palm) single nucleotide polymorphism (SNP) in genomic region adjacent to shatterproof1 (SHELL) shell thickness gene
taaatcaaccttagacatgaaccawggaggattcaaagcaaagtgtgttc

SEQ ID NO: 519 - DNA, 50 bp, Artificial Sequence
  synthetic Elaeis guineensis (oil palm) single nucleotide polymorphism (SNP) in genomic region adjacent to shatterproof1 (SHELL) shell thickness gene
taccatactttaaatacaatgcgakgaaagagatcgagtaaagttagccc

SEQ ID NO: 520 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttaaatacaatgcgaggaaagagrtcgagtaaagttagccctatgagat

SEQ ID NO: 521 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgaactggatacaaggtggggaagraaaggagatgggttgatatagaaag

SEQ ID NO: 522 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgggttgatatagaaaggggaagtkgaaaaggatggtgggtagataaggg

SEQ ID NO: 523 - DNA, 50 bp, Artificial Sequence
  synthetic Elaeis guineensis (oil palm) single nucleotide polymorphism (SNP) in genomic region adjacent to shatterproof1 (SHELL) shell thickness gene
cttgaatgctgaatttgaatggtartagcgtcataggctcgcaagtttta

SEQ ID NO: 524 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgaatggtagtagcgtcataggctygcaagttttagcctagaaagtggaa

SEQ ID NO: 525 - DNA, 50 bp, Artificial Sequence
  synthetic Elaeis guineensis (oil palm) single nucleotide polymorphism (SNP) in genomic region adjacent to shatterproof1 (SHELL) shell thickness gene
agttttagcctagaaagtggaactkgatcagagtttttttattagaaaaa

SEQ ID NO: 526 - DNA, 50 bp, Artificial Sequence
  synthetic Elaeis guineensis (oil palm) single nucleotide polymorphism (SNP) in genomic region adjacent to shatterproof1 (SHELL) shell thickness gene
cagtaaccatcattggactacttcyatgaattatggcttaggcttggaac

SEQ ID NO: 527 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttacttggtttccggccattttttwaacttgaatgctgtggccatactct

SEQ ID NO: 528 - DNA, 50 bp, Artificial Sequence
  synthetic Elaeis guineensis (oil palm) single nucleotide polymorphism (SNP) in genomic region adjacent to shatterproof1 (SHELL) shell thickness gene
acttgaatgctgtggccatactctwaagaatatcattatgttttttctga

SEQ ID NO: 529 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccatactcttaagaatatcattatrttttttctgaaaatatatgtggtga

SEQ ID NO: 530 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggtccatgcatggatccaaaacttwggagcactattcctgggaaacgtgg

SEQ ID NO: 531 - DNA, 50 bp, Artificial Sequence
  synthetic Elaeis guineensis (oil palm) single nucleotide polymorphism (SNP) in genomic region adjacent to shatterproof1 (SHELL) shell thickness gene
aattaggtttaagccctttaaaagrgcctgtgacgaacagtgaacagcag

SEQ ID NO: 532 - DNA, 50 bp, Artificial Sequence
  synthetic Elaeis guineensis (oil palm) single nucleotide polymorphism (SNP) in genomic region adjacent to shatterproof1 (SHELL) shell thickness gene
taatccacgtattttgattattttrttttatttcttttttcttcctgctg

SEQ ID NO: 533 - DNA, 50 bp, Artificial Sequence
  synthetic Elaeis guineensis (oil palm) single nucleotide polymorphism (SNP) in genomic region adjacent to shatterproof1 (SHELL) shell thickness gene
gataaatggagctaaaacctttgaygcttatacaaagaataacttcagtt

SEQ ID NO: 534 - DNA, 50 bp, Artificial Sequence
  synthetic Elaeis guineensis (oil palm) single nucleotide polymorphism (SNP) in genomic region adjacent to shatterproof1 (SHELL) shell thickness gene
agagataagcctaaaccattgtctrgtgcagagattttaaagatgctaga

SEQ ID NO: 535 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtcttttgggagcagaaatgtgagrgctagatacaatcaatccaatacta

SEQ ID NO: 536 - DNA, 50 bp, Artificial Sequence
  synthetic Elaeis guineensis (oil palm) single nucleotide polymorphism (SNP) in genomic region adjacent to shatterproof1 (SHELL) shell thickness gene
agatacaatcaatccaatactattyttaattggaggaaaaagagtattct

SEQ ID NO: 537 - DNA, 50 bp, Artificial Sequence
  synthetic Elaeis guineensis (oil palm) single nucleotide polymorphism (SNP) in genomic region adjacent to shatterproof1 (SHELL) shell thickness gene
atgcatattgaaaaaaatatttatsaaaatattatggagacaataaagaa

SEQ ID NO: 538 - DNA, 50 bp, Artificial Sequence
  synthetic Elaeis guineensis (oil palm) single nucleotide polymorphism (SNP) in genomic region adjacent to shatterproof1 (SHELL) shell thickness gene
gttaagtaggtgtgtgagtgaaaaraagcaaaaattttttgatatgaaga

SEQ ID NO: 539 - DNA, 50 bp, Artificial Sequence
  synthetic Elaeis guineensis (oil palm) single nucleotide polymorphism (SNP) in genomic region adjacent to shatterproof1 (SHELL) shell thickness gene
acaaaacaatatctctgatgatttyttttttttggctttagattcatcat

SEQ ID NO: 540 - DNA, 50 bp, Artificial Sequence
  synthetic Elaeis guineensis (oil palm) single nucleotide polymorphism (SNP) in genomic region adjacent to shatterproof1 (SHELL) shell thickness gene
atctctgatgatttcttttttttgrctttagattcatcatttgctttcaa

SEQ ID NO: 541 - DNA, 50 bp, Artificial Sequence
  synthetic Elaeis guineensis (oil palm) single nucleotide polymorphism (SNP) in genomic region adjacent to shatterproof1 (SHELL) shell thickness gene
aactataatcaagccaaaacacaamcataccttttagaatcagaataaat

SEQ ID NO: 542 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttatatctttgcttgtttattatgyaacaagtatgcaattaaagaatcat

SEQ ID NO: 543 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatctttgcttgtttattatgcaayaagtatgcaattaaagaatcatgaa

SEQ ID NO: 544 - DNA, 50 bp, Artificial Sequence
  synthetic Elaeis guineensis (oil palm) single nucleotide polymorphism (SNP) in genomic region adjacent to shatterproof1 (SHELL) shell thickness gene
atgtttgtttgattaatgctacatmcatttaagtttctatcatttatata

SEQ ID NO: 545 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcatatctaccactaggtcaaaatyattttatcaaaaggagtatgaaatg

SEQ ID NO: 546 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttttatcaaaaggagtatgaaatgrtaagctgttcaaattgttgtattac

SEQ ID NO: 547 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtttacatgtgtctcttaatttttyctcataaacatatgatagatgaatc

SEQ ID NO: 548 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaactagatcataacctattgttgmaagggtgcagaaggatgaaatagtc

SEQ ID NO: 549 - DNA, 50 bp, Artificial Sequence
  synthetic Elaeis guineensis (oil palm) single nucleotide polymorphism (SNP) in genomic region adjacent to shatterproof1 (SHELL) shell thickness gene
taatcaattgttaattctcatgcartaaatttttctcatccaatttgtat

SEQ ID NO: 550 - DNA, 50 bp, Artificial Sequence
  synthetic Elaeis guineensis (oil palm) single nucleotide polymorphism (SNP) in genomic region adjacent to shatterproof1 (SHELL) shell thickness gene
aggggctggttataagttaattatrattgagacagcaaagaccattcaca

SEQ ID NO: 551 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagagaaaatccatgaagaaaaaayatgtagatatgcaagcaaagttaca

SEQ ID NO: 552 - DNA, 50 bp, Artificial Sequence
  synthetic Elaeis guineensis (oil palm) single nucleotide polymorphism (SNP) in genomic region adjacent to shatterproof1 (SHELL) shell thickness gene
tagtttggttggctaacatgatttwgttacacactattggtgttatgtct

SEQ ID NO: 553 - DNA, 50 bp, Artificial Sequence
  synthetic Elaeis guineensis (oil palm) single nucleotide polymorphism (SNP) in genomic region adjacent to shatterproof1 (SHELL) shell thickness gene
tggtgttatgtctctaatttaattrtcatttgttatttgctattctttta

SEQ ID NO: 554 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgtaatacccgatccatttgggccrtggatcaggcccaaaatctgagagg

SEQ ID NO: 555 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaatttagagaacgacgaggatcgycagagttttctcgtggaagtccttc

SEQ ID NO: 556 - DNA, 50 bp, Artificial Sequence
  synthetic Elaeis guineensis (oil palm) single nucleotide polymorphism (SNP) in genomic region adjacent to shatterproof1 (SHELL) shell thickness gene
cgaaaaacaaaaggaaaaggggcakgtcccttattttttgaatatttttt

SEQ ID NO: 557 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttttctttctctaattgcatcatrgaccataggatgaacttgagatgaa

SEQ ID NO: 558 - DNA, 50 bp, Artificial Sequence
  synthetic Elaeis guineensis (oil palm) single nucleotide polymorphism (SNP) in genomic region adjacent to shatterproof1 (SHELL) shell thickness gene
attcatgcagtaggttggatctcartctgatccttattcgaaatttataa

SEQ ID NO: 559 - DNA, 50 bp, Artificial Sequence
  synthetic Elaeis guineensis (oil palm) single nucleotide polymorphism (SNP) in genomic region adjacent to shatterproof1 (SHELL) shell thickness gene
atgatcaccattatatatgctatcrttggtattgtatcattggttttgta

SEQ ID NO: 560 - DNA, 50 bp, Artificial Sequence
  synthetic Elaeis guineensis (oil palm) single nucleotide polymorphism (SNP) in genomic region adjacent to shatterproof1 (SHELL) shell thickness gene
gctatcattggtattgtatcattgrttttgtattgttgaatccgtgatcg

SEQ ID NO: 561 - DNA, 50 bp, Artificial Sequence
  synthetic Elaeis guineensis (oil palm) single nucleotide polymorphism (SNP) in genomic region adjacent to shatterproof1 (SHELL) shell thickness gene
atctgagaaagatcatgaatatttygattcgagaaagattataaaagtcg

SEQ ID NO: 562 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgatagataatatcagagcttaacrttatgatcattaaggatatgataga

SEQ ID NO: 563 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatatgatttaagtggtatttgatyttaagattataattattcaaaatta

SEQ ID NO: 564 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttaataatctttggattagattcyttatttatgtaattcaaatcaaaat

SEQ ID NO: 565 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttatttatgtaattcaaatcaaarttaaaatttctgagctgatctaagg

SEQ ID NO: 566 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtagtgaagcttatgtaatgagttyaaacatagaaggtggatgaagattt

SEQ ID NO: 567 - DNA, 50 bp, Artificial Sequence
  synthetic Elaeis guineensis (oil palm) single nucleotide polymorphism (SNP) in genomic region adjacent to shatterproof1 (SHELL) shell thickness gene
agatttaattttgatgtgctatgcytaagagatagtaatgataaagaaac

SEQ ID NO: 568 - DNA, 50 bp, Artificial Sequence
  synthetic Elaeis guineensis (oil palm) single nucleotide polymorphism (SNP) in genomic region adjacent to shatterproof1 (SHELL) shell thickness gene
gctatgcctaagagatagtaatgayaaagaaacttaaaaattttatcgta

SEQ ID NO: 569 - DNA, 50 bp, Artificial Sequence
  synthetic Elaeis guineensis (oil palm) single nucleotide polymorphism (SNP) in genomic region adjacent to shatterproof1 (SHELL) shell thickness gene
gattattttattgtagataatgccwagaagaatcctagacatctcaagtt

SEQ ID NO: 570 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatatggcacaatatcaaacaaatrtctttcagagcctccagacatatga

SEQ ID NO: 571 - DNA, 50 bp, Artificial Sequence
  synthetic Elaeis guineensis (oil palm) single nucleotide polymorphism (SNP) in genomic region adjacent to shatterproof1 (SHELL) shell thickness gene
gatttcgagttgtgtatgggtcacyagttttgagctaattcaatgttttc

SEQ ID NO: 572 - DNA, 50 bp, Artificial Sequence
  synthetic Elaeis guineensis (oil palm) single nucleotide polymorphism (SNP) in genomic region adjacent to shatterproof1 (SHELL) shell thickness gene
acgtgcctaatatatgtaaataatrttctcaattacttttaagcatacga

SEQ ID NO: 573 - DNA, 50 bp, Artificial Sequence
  synthetic Elaeis guineensis (oil palm) single nucleotide polymorphism (SNP) in genomic region adjacent to shatterproof1 (SHELL) shell thickness gene
atttaagtactaaaaattatatctwtaaagtagctaaggtgtaatataac

SEQ ID NO: 574 - DNA, 50 bp, Artificial Sequence
  synthetic Elaeis guineensis (oil palm) single nucleotide polymorphism (SNP) in genomic region adjacent to shatterproof1 (SHELL) shell thickness gene
tactaaaaattatatctataaagtwgctaaggtgtaatataactatatgg

SEQ ID NO: 575 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctagcaaccatgtataattccttcrctagcaaccaggaatccacttcata

SEQ ID NO: 576 - DNA, 50 bp, Artificial Sequence
  synthetic Elaeis guineensis (oil palm) single nucleotide polymorphism (SNP) in genomic region adjacent to shatterproof1 (SHELL) shell thickness gene
caagtgatgattaggctatctaacrtggtaaccatcacaatggcataata

SEQ ID NO: 577 - DNA, 50 bp, Artificial Sequence
  synthetic Elaeis guineensis (oil palm) single nucleotide polymorphism (SNP) in genomic region adjacent to shatterproof1 (SHELL) shell thickness gene
taaccatcacaatggcataatatcyacagtagaataggagcatgatcaaa

SEQ ID NO: 578 - DNA, 50 bp, Artificial Sequence
  synthetic Elaeis guineensis (oil palm) single nucleotide polymorphism (SNP) in genomic region adjacent to shatterproof1 (SHELL) shell thickness gene
atgcactaatagcttttgtaaaaawtatcgctaatatgacctaggattct

SEQ ID NO: 579 - DNA, 50 bp, Artificial Sequence
  synthetic Elaeis guineensis (oil palm) single nucleotide polymorphism (SNP) in genomic region adjacent to shatterproof1 (SHELL) shell thickness gene
agaaataaagaagctaactagtttyatcctacttatcaagaagtttagta

SEQ ID NO: 580 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaagctaactagttttatcctactyatcaagaagtttagtaacattatat

SEQ ID NO: 581 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgattatgaacttgtattgttatawtcccaataatgtatgtagtatatat

SEQ ID NO: 582 - DNA, 50 bp, Artificial Sequence
  synthetic Elaeis guineensis (oil palm) single nucleotide polymorphism (SNP) in genomic region adjacent to shatterproof1 (SHELL) shell thickness gene
attgttatattcccaataatgtatstagtatatattatctatttttatag

SEQ ID NO: 583 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaaatttggatttgattagagaaragtttgggcttgagaattctggatg

SEQ ID NO: 584 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaattctggatgcattagatttggrtatctcaagtaaagcaagattgtgc

SEQ ID NO: 585 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcattagatttgggtatctcaagtmaagcaagattgtgccacagagtcaa

SEQ ID NO: 586 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctcaagtaaagcaagattgtgccmcagagtcaaccctatgagctgcttg

SEQ ID NO: 587 - DNA, 50 bp, Artificial Sequence
  synthetic Elaeis guineensis (oil palm) single nucleotide polymorphism (SNP) in genomic region adjacent to shatterproof1 (SHELL) shell thickness gene
cctaagggctgggcttattaacatygagggcgacttagttatagcggtca

SEQ ID NO: 588 - DNA, 50 bp, Artificial Sequence
  synthetic Elaeis guineensis (oil palm) single nucleotide polymorphism (SNP) in genomic region adjacent to shatterproof1 (SHELL) shell thickness gene
cttccgcaggatatttgaaaaatgrtgagaaagtattatatatatatata

SEQ ID NO: 589 - DNA, 50 bp, Artificial Sequence
  synthetic Elaeis guineensis (oil palm) single nucleotide polymorphism (SNP) in genomic region adjacent to shatterproof1 (SHELL) shell thickness gene
agaaagtattatatatatatatatwttttgatactaagtatgtttattag

SEQ ID NO: 590 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagaagacgctgggccgcgcggagmcgctacccaagtggaccgacgccga

SEQ ID NO: 591 - DNA, 50 bp, Artificial Sequence
  synthetic Elaeis guineensis (oil palm) single nucleotide polymorphism (SNP) in genomic region adjacent to shatterproof1 (SHELL) shell thickness gene
gattaggttttgtattggatggatyttgatgggtcttgtcttgattcagt

SEQ ID NO: 592 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgttcattttctttggtcttggcgytttatttgggatttatctgagcttt

SEQ ID NO: 593 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatcaacagttggatcttttgtttkgaatggtcttatctatattgcattt

SEQ ID NO: 594 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtgcaagtaggttttcccaaaatcrtattaaagatgatagcctgtggaaa

SEQ ID NO: 595 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggaagaaattcataaagtcccagtwtatttgactatgttcactaaaagaa

SEQ ID NO: 596 - DNA, 50 bp, Artificial Sequence
  synthetic Elaeis guineensis (oil palm) single nucleotide polymorphism (SNP) in genomic region adjacent to shatterproof1 (SHELL) shell thickness gene
tggacatgttgcttcttattattgytcattcttgaccagttattgtaatt

SEQ ID NO: 597 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctttcctcataatcagggcctaaamatttgattttgttttggtttttcta

SEQ ID NO: 598 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttaagttgctaatcaattaaatgcwtgaggttatagaatatcataattat

SEQ ID NO: 599 - DNA, 50 bp, Artificial Sequence
  synthetic Elaeis guineensis (oil palm) single nucleotide polymorphism (SNP) in genomic region adjacent to shatterproof1 (SHELL) shell thickness gene
agttattatctttccctcttttaaytcaagtaatggagagaaaagtcatt

SEQ ID NO: 600 - DNA, 50 bp, Artificial Sequence
  synthetic Elaeis guineensis (oil palm) single nucleotide polymorphism (SNP) in genomic region adjacent to shatterproof1 (SHELL) shell thickness gene
gttgtgcatttaattgtcgatacaygaaatgacacatataccattccttt

SEQ ID NO: 601 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctgcattttgatgtgaaatgtaaamttcatgatacactattaatattgac

SEQ ID NO: 602 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtaaaattcatgatacactattaayattgacagtaaaggaaccaaacaag

SEQ ID NO: 603 - DNA, 50 bp, Artificial Sequence
  synthetic Elaeis guineensis (oil palm) single nucleotide polymorphism (SNP) in genomic region adjacent to shatterproof1 (SHELL) shell thickness gene
acactcatatttcatcagtgttggmgttttgagataataatgcaaaatga

SEQ ID NO: 604 - DNA, 50 bp, Artificial Sequence
  synthetic Elaeis guineensis (oil palm) single nucleotide polymorphism (SNP) in genomic region adjacent to shatterproof1 (SHELL) shell thickness gene
agataataatgcaaaatgactgatyttataaactgcaaattttggtcttt

SEQ ID NO: 605 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgacatccttactagtgcttgacayttttcttttaattaccaattctttg

SEQ ID NO: 606 - DNA, 50 bp, Artificial Sequence
  synthetic Elaeis guineensis (oil palm) single nucleotide polymorphism (SNP) in genomic region adjacent to shatterproof1 (SHELL) shell thickness gene
tggaatggacctcttttccctttayagttgaaagctctaagggaatcaag

SEQ ID NO: 607 - DNA, 50 bp, Artificial Sequence
  synthetic Elaeis guineensis (oil palm) single nucleotide polymorphism (SNP) in genomic region adjacent to shatterproof1 (SHELL) shell thickness gene
tattcaaagagcccacatggtactktagctttattactgtcatacttctt

SEQ ID NO: 608 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgagtgcagcacataaacaggtttrgcaatcatatactatattttgtaca

SEQ ID NO: 609 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcaatctgcagtaatgctgagcatwagcatttgaagataaacctttttgt

SEQ ID NO: 610 - DNA, 50 bp, Artificial Sequence
  synthetic Elaeis guineensis (oil palm) single nucleotide polymorphism (SNP) in genomic region adjacent to shatterproof1 (SHELL) shell thickness gene
caataaaagttagtgcatagttccygtgtttactctttaatgattattgc

SEQ ID NO: 611 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttaaactcatgagaccagaagatarggctgtgaattgatctgagatgctt

SEQ ID NO: 612 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctgagtgatcatgtatttcacaatrtatttaatactttttagatttatat

SEQ ID NO: 613 - DNA, 50 bp, Artificial Sequence
  synthetic Elaeis guineensis (oil palm) single nucleotide polymorphism (SNP) in genomic region adjacent to shatterproof1 (SHELL) shell thickness gene
tagatcattacaatgctcattcacragcaggagcatgggccacaggtgtt

SEQ ID NO: 614 - DNA, 50 bp, Artificial Sequence
  synthetic Elaeis guineensis (oil palm) single nucleotide polymorphism (SNP) in genomic region adjacent to shatterproof1 (SHELL) shell thickness gene
agtgatgagagttagagagagtgcragtgagccagattttgctggccatg

SEQ ID NO: 615 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatttccctaatttgaaccattaartaattggataaaaaacagataattc

SEQ ID NO: 616 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggtgtccaacactgcttaaacacayagctagagtgtatctgcttgagtca

SEQ ID NO: 617 - DNA, 50 bp, Artificial Sequence
  synthetic Elaeis guineensis (oil palm) single nucleotide polymorphism (SNP) in genomic region adjacent to shatterproof1 (SHELL) shell thickness gene
cagccttttttttttggttatgttyttctctactttgccatttctgtatg

SEQ ID NO: 618 - DNA, 50 bp, Artificial Sequence
  synthetic Elaeis guineensis (oil palm) single nucleotide polymorphism (SNP) in genomic region adjacent to shatterproof1 (SHELL) shell thickness gene
catatccgtccccatcctatatccrttttgggtcgaatcaggtcgagtaa

SEQ ID NO: 619 - DNA, 50 bp, Artificial Sequence
  synthetic Elaeis guineensis (oil palm) single nucleotide polymorphism (SNP) in genomic region adjacent to shatterproof1 (SHELL) shell thickness gene
agaatggattgggtcgggtcgggtygggtatcttcccttgcatggggtcg

SEQ ID NO: 620 - DNA, 50 bp, Artificial Sequence
  synthetic Elaeis guineensis (oil palm) single nucleotide polymorphism (SNP) in genomic region adjacent to shatterproof1 (SHELL) shell thickness gene
atatagaataattgggaaaacagtrgttacaacagcaatacatgctcaca

SEQ ID NO: 621 - DNA, 50 bp, Artificial Sequence
  synthetic Elaeis guineensis (oil palm) single nucleotide polymorphism (SNP) in genomic region adjacent to shatterproof1 (SHELL) shell thickness gene
agcaatacatgctcacaacggcacwacccacttaaacataaaggctacta

SEQ ID NO: 622 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaagataaccaccctccttaccaamaaaagatttcacaaattatggggat

SEQ ID NO: 623 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatgttatccggtcaggttcgagayggggcatactattatctgcacctga

SEQ ID NO: 624 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtgtgcccttcaggtgttatgaatwttcccttttgcttttacctgattag

SEQ ID NO: 625 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcattaaattgtgcagccaggtgamttttgcgcttaatctttgggaacag

SEQ ID NO: 626 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctctctcatatatatgctcggtagvccacgggagtaccagcccatgctgg

SEQ ID NO: 627 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctttaattttcatgattatataatytgactgttactcttgatgaaagata

SEQ ID NO: 628 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaatcaaagaaagcttctacttcyaccccaaaataaggaaatcttttac

SEQ ID NO: 629 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgtggcacgtacgtgatacgtccawatttcgagatgcctttccagggcat

SEQ ID NO: 630 - DNA, 50 bp, Artificial Sequence
  synthetic Elaeis guineensis (oil palm) single nucleotide polymorphism (SNP) in genomic region adjacent to shatterproof1 (SHELL) shell thickness gene
tccaaatttcgagatgcctttccarggcatgcagctcctccagtgtcata

SEQ ID NO: 631 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctccagacatgtacctgtcacccawgttctttgaactcatgcacaaactt

SEQ ID NO: 632 - DNA, 50 bp, Artificial Sequence
  synthetic Elaeis guineensis (oil palm) single nucleotide polymorphism (SNP) in genomic region adjacent to shatterproof1 (SHELL) shell thickness gene
gttgaggcaggcaaaaacggaacayatatttaagcatgcaaccacaacaa

SEQ ID NO: 633 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtttattggtaaagaaaggtccatycaaccatccactaaactaggagaag

SEQ ID NO: 634 - DNA, 50 bp, Artificial Sequence
  synthetic Elaeis guineensis (oil palm) single nucleotide polymorphism (SNP) in genomic region adjacent to shatterproof1 (SHELL) shell thickness gene
tattggtaaagaaaggtccattcamccatccactaaactaggagaaggct

SEQ ID NO: 635 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcgttataaattctaactctctccyaattcatgattacatgctggaagga

SEQ ID NO: 636 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaagcaataaattatgagttgcatyctttgtgacaaattggcctagagcc

SEQ ID NO: 637 - DNA, 50 bp, Artificial Sequence
  synthetic Elaeis guineensis (oil palm) single nucleotide polymorphism (SNP) in genomic region adjacent to shatterproof1 (SHELL) shell thickness gene
aattttattctataagaaacacttyttttgagatatgaagaaattgcata

SEQ ID NO: 638 - DNA, 50 bp, Artificial Sequence
  synthetic Elaeis guineensis (oil palm) single nucleotide polymorphism (SNP) in genomic region adjacent to shatterproof1 (SHELL) shell thickness gene
gctttgtacccctaggtatggcttktcctagagttttgcaaactgccagg

SEQ ID NO: 639 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaagttgctaaaatgactaaaaaawgaaaagaggagacctgatggtgtgt

SEQ ID NO: 640 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaaaatgaaaagaggagacctgayggtgtgttaccattctgtctcattt

SEQ ID NO: 641 - DNA, 50 bp, Artificial Sequence
  synthetic Elaeis guineensis (oil palm) single nucleotide polymorphism (SNP) in genomic region adjacent to shatterproof1 (SHELL) shell thickness gene
taccattctgtctcatttaagcctmaatcatccaaagctatttaggggtg

SEQ ID NO: 642 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcatttaagcctaaatcatccaaarctatttaggggtgcgcctaggttcc

SEQ ID NO: 643 - DNA, 50 bp, Artificial Sequence
  synthetic Elaeis guineensis (oil palm) single nucleotide polymorphism (SNP) in genomic region adjacent to shatterproof1 (SHELL) shell thickness gene
cggcggcctaatgcgctaaggattrtgttgtaagtagatattggaaaaag

SEQ ID NO: 644 - DNA, 50 bp, Artificial Sequence
  synthetic Elaeis guineensis (oil palm) single nucleotide polymorphism (SNP) in genomic region adjacent to shatterproof1 (SHELL) shell thickness gene
cggctagggtttcattctttatcckattatgttcatccttctcggttcct

SEQ ID NO: 645 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttctagtaaaaaactaatatgaaaytaaatacatgctcacacgacagtct

SEQ ID NO: 646 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtcctaggttgttacaattatagtraaaattttattattacactaaagga

SEQ ID NO: 647 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttaaaatatttattattaaaaaaktatatgatttggagatccctactta

SEQ ID NO: 648 - DNA, 50 bp, Artificial Sequence
  synthetic Elaeis guineensis (oil palm) single nucleotide polymorphism (SNP) in genomic region adjacent to shatterproof1 (SHELL) shell thickness gene
gggatctccagactgtatgattttytgatagtaaatagtttagagatagt

SEQ ID NO: 649 - DNA, 50 bp, Artificial Sequence
  synthetic Elaeis guineensis (oil palm) single nucleotide polymorphism (SNP) in genomic region adjacent to shatterproof1 (SHELL) shell thickness gene
atctccagactgtatgattttttgrtagtaaatagtttagagatagtaga

SEQ ID NO: 650 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaaggcatagcttatatattaatgmtatcatccaattaatttatgtaatt

SEQ ID NO: 651 - DNA, 50 bp, Artificial Sequence
  synthetic Elaeis guineensis (oil palm) single nucleotide polymorphism (SNP) in genomic region adjacent to shatterproof1 (SHELL) shell thickness gene
cctaaacccataggcatgaagaatrgaaatcatgtattacagaagcctgt

SEQ ID NO: 652 - DNA, 50 bp, Artificial Sequence
  synthetic Elaeis guineensis (oil palm) single nucleotide polymorphism (SNP) in genomic region adjacent to shatterproof1 (SHELL) shell thickness gene
acagataagctaactaaaagagggyaagtctttgtttttttagaagaaaa

SEQ ID NO: 653 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcaggatgatagattgtcatcgtcrtagagggtgactctataacagtggt

SEQ ID NO: 654 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctattgtgacttagattttatggrtttaaaatacagaaatagcctcttt

SEQ ID NO: 655 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatgtttgaccctcatttgatcccrcagtaacgagggccttgtgcattgg

SEQ ID NO: 656 - DNA, 50 bp, Artificial Sequence
  synthetic Elaeis guineensis (oil palm) single nucleotide polymorphism (SNP) in genomic region adjacent to shatterproof1 (SHELL) shell thickness gene
atttcctccacaacaccaaattttrctttttttttttcttttgaatctag

SEQ ID NO: 657 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatatgcacgtgaacaaatattgcrtgcataggcatgatcacatgcatga

SEQ ID NO: 658 - DNA, 50 bp, Artificial Sequence
  synthetic Elaeis guineensis (oil palm) single nucleotide polymorphism (SNP) in genomic region adjacent to shatterproof1 (SHELL) shell thickness gene
aggcatgatcacatgcatgaatgcrcacagatgtgcatgtacatatttat

SEQ ID NO: 659 - DNA, 50 bp, Artificial Sequence
  synthetic Elaeis guineensis (oil palm) single nucleotide polymorphism (SNP) in genomic region adjacent to shatterproof1 (SHELL) shell thickness gene
catgaatgcgcacagatgtgcatgwacatatttatgcatagacacaagca

SEQ ID NO: 660 - DNA, 50 bp, Artificial Sequence
  synthetic Elaeis guineensis (oil palm) single nucleotide polymorphism (SNP) in genomic region adjacent to shatterproof1 (SHELL) shell thickness gene
atgtgcatgtacatatttatgcatrgacacaagcaggcatgaacaaacac

SEQ ID NO: 661 - DNA, 50 bp, Artificial Sequence
  synthetic Elaeis guineensis (oil palm) single nucleotide polymorphism (SNP) in genomic region adjacent to shatterproof1 (SHELL) shell thickness gene
cggtgcagagaaattatagctctgragtgcgtgcaattttgtttcttatt

SEQ ID NO: 662 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaggatttgaggtgtttaagttggycattcgtagtacctagcaaacagta

SEQ ID NO: 663 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttcctaccatgcttttctgaatakcccacttttatatggcgatagtgag

SEQ ID NO: 664 - DNA, 50 bp, Artificial Sequence
  synthetic Elaeis guineensis (oil palm) single nucleotide polymorphism (SNP) in genomic region adjacent to shatterproof1 (SHELL) shell thickness gene
caatgggcccttgcaagtcttcatkatacatataattcttggttaatgag

SEQ ID NO: 665 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggaggctctcattgatgggaatccycctccacccaccagtgacagtctat

SEQ ID NO: 666 - DNA, 50 bp, Artificial Sequence
  synthetic Elaeis guineensis (oil palm) single nucleotide polymorphism (SNP) in genomic region adjacent to shatterproof1 (SHELL) shell thickness gene
aactgaagctgagacatggaagatyatgtgtaataacatttatgtggcag

SEQ ID NO: 667 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttccgaaggaatcaggtcatcagygaacattctttggacctcatataag

SEQ ID NO: 668 - DNA, 50 bp, Artificial Sequence
  synthetic Elaeis guineensis (oil palm) single nucleotide polymorphism (SNP) in genomic region adjacent to shatterproof1 (SHELL) shell thickness gene
attccattttagccacatatgcacrtactcattttgcgtgaactctcgtg

SEQ ID NO: 669 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatgcacatactcattttgcgtgawctctcgtgtgtttttcatataaatt

SEQ ID NO: 670 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttgcttgaagtcacattgaagttkcccacttgattcagtttgctaaatt

SEQ ID NO: 671 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaagccgcctctctttttctcccmagaaaaagagagatagtggtagtgc

SEQ ID NO: 672 - DNA, 50 bp, Artificial Sequence
  synthetic Elaeis guineensis (oil palm) single nucleotide polymorphism (SNP) in genomic region adjacent to shatterproof1 (SHELL) shell thickness gene
acttaacacctttcatctctttctkaagataagaaagaatattttgtata

SEQ ID NO: 673 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttgcctaggtctctattgtcaccyagtgaattgtttgagactctaaaat

SEQ ID NO: 674 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagtatcctttaaagtttgcacatrtcattcatgactacatcaagtaatt

SEQ ID NO: 675 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcttcaaaatgcaaatctatgaatsgagaattataggtgtgccagatcga

SEQ ID NO: 676 - DNA, 50 bp, Artificial Sequence
  synthetic Elaeis guineensis (oil palm) single nucleotide polymorphism (SNP) in genomic region adjacent to shatterproof1 (SHELL) shell thickness gene
ataactcaaagataaaataaccaaygaataacattgattataaataagaa

SEQ ID NO: 677 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttgattataaataagaataattgartataagtaattctttagggagattt

SEQ ID NO: 678 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttgattttctccaagatggaatgaracatcacattagagaactattgatt

SEQ ID NO: 679 - DNA, 50 bp, Artificial Sequence
  synthetic Elaeis guineensis (oil palm) single nucleotide polymorphism (SNP) in genomic region adjacent to shatterproof1 (SHELL) shell thickness gene
ataaaaactttttctatgttgggtrgttaaatatccatgcatgcatagag

SEQ ID NO: 680 - DNA, 50 bp, Artificial Sequence
  synthetic Elaeis guineensis (oil palm) single nucleotide polymorphism (SNP) in genomic region adjacent to shatterproof1 (SHELL) shell thickness gene
tagctcctcttaaatagttaattcyaatatttgaccacccaaatatgacg

SEQ ID NO: 681 - DNA, 50 bp, Artificial Sequence
  synthetic Elaeis guineensis (oil palm) single nucleotide polymorphism (SNP) in genomic region adjacent to shatterproof1 (SHELL) shell thickness gene
taatatttgaccacccaaatatgaygttttatatacgtgccaagtggcca

SEQ ID NO: 682 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaataattattaattaaatattgrttggtataataatattattcattta

SEQ ID NO: 683 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttattatagttggttgatggtaamttaattcatagggataaacattacc

SEQ ID NO: 684 - DNA, 50 bp, Artificial Sequence
  synthetic Elaeis guineensis (oil palm) single nucleotide polymorphism (SNP) in genomic region adjacent to shatterproof1 (SHELL) shell thickness gene
tagtaacatgcatgatcataggcaycattttatgtggattgatcatgcct

SEQ ID NO: 685 - DNA, 50 bp, Artificial Sequence
  synthetic Elaeis guineensis (oil palm) single nucleotide polymorphism (SNP) in genomic region adjacent to shatterproof1 (SHELL) shell thickness gene
atgatcataggcatcattttatgtkgattgatcatgcctatcaaccataa

SEQ ID NO: 686 - DNA, 50 bp, Artificial Sequence
  synthetic Elaeis guineensis (oil palm) single nucleotide polymorphism (SNP) in genomic region adjacent to shatterproof1 (SHELL) shell thickness gene
ataacaagtctctactcacagtccycttattattgttgtcgagcatatat

SEQ ID NO: 687 - DNA, 50 bp, Artificial Sequence
  synthetic Elaeis guineensis (oil palm) single nucleotide polymorphism (SNP) in genomic region adjacent to shatterproof1 (SHELL) shell thickness gene
accaattataataattattattggwcaaaataaatttcaatctataattt

SEQ ID NO: 688 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttttataaccaattggatcattgcstcgcaaatatttgagtactttcagt

SEQ ID NO: 689 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcattgcgtcgcaaatatttgagtrctttcagttgatcagccttttcaag

SEQ ID NO: 690 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttattaattcactgctaattgcgawatagatcacttaggctctttaagcc

SEQ ID NO: 691 - DNA, 50 bp, Artificial Sequence
  synthetic Elaeis guineensis (oil palm) single nucleotide polymorphism (SNP) in genomic region adjacent to shatterproof1 (SHELL) shell thickness gene
tggggccatcaaggagagcatattmatatgatcacatatatcaaccattc

SEQ ID NO: 692 - DNA, 50 bp, Artificial Sequence
  synthetic Elaeis guineensis (oil palm) single nucleotide polymorphism (SNP) in genomic region adjacent to shatterproof1 (SHELL) shell thickness gene
gatcattcccttcagaaagcttcastttatttcattgccttggagctttt

SEQ ID NO: 693 - DNA, 50 bp, Artificial Sequence
  synthetic Elaeis guineensis (oil palm) single nucleotide polymorphism (SNP) in genomic region adjacent to shatterproof1 (SHELL) shell thickness gene
agcttcagtttatttcattgccttrgagcttttctttgacattttatcct

SEQ ID NO: 694 - DNA, 50 bp, Artificial Sequence
  synthetic Elaeis guineensis (oil palm) single nucleotide polymorphism (SNP) in genomic region adjacent to shatterproof1 (SHELL) shell thickness gene
agaatttcaaagctcactagtgatwgcaattgaataacaacaagaataca

SEQ ID NO: 695 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaagctcactagtgatagcaattgmataacaacaagaatacaaacccaag

SEQ ID NO: 696 - DNA, 50 bp, Artificial Sequence
  synthetic Elaeis guineensis (oil palm) single nucleotide polymorphism (SNP) in genomic region adjacent to shatterproof1 (SHELL) shell thickness gene
gatctcaatgccgtttgcccatgaycatcatgtgaccacacctggcccac

SEQ ID NO: 697 - DNA, 50 bp, Artificial Sequence
  synthetic Elaeis guineensis (oil palm) single nucleotide polymorphism (SNP) in genomic region adjacent to shatterproof1 (SHELL) shell thickness gene
caatcatacatagcttctgattttkatcatacatcacctctgatccgacc

SEQ ID NO: 698 - DNA, 50 bp, Artificial Sequence
  synthetic Elaeis guineensis (oil palm) single nucleotide polymorphism (SNP) in genomic region adjacent to shatterproof1 (SHELL) shell thickness gene
caacttgagtgccctccacagctcsgataggtcaagcctagagaagaagg

SEQ ID NO: 699 - DNA, 50 bp, Artificial Sequence
  synthetic Elaeis guineensis (oil palm) single nucleotide polymorphism (SNP) in genomic region adjacent to shatterproof1 (SHELL) shell thickness gene
tccacagctcggataggtcaagccyagagaagaaggatattagattgaag

SEQ ID NO: 700 - DNA, 50 bp, Artificial Sequence
  synthetic Elaeis guineensis (oil palm) single nucleotide polymorphism (SNP) in genomic region adjacent to shatterproof1 (SHELL) shell thickness gene
gccgcatggcacttcaccactgtcrtttgctcctcctcgagagccccttc

SEQ ID NO: 701 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccccttcttgaaccaaggatcgcaraggatcccatcgatggtgatccttg

SEQ ID NO: 702 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttggggcatcggtactccctccaayagatcttgcagttcatcgccatcaa

SEQ ID NO: 703 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttaaggacgtaaagaataatgctgyaggaccagatgtcgatcttggtgcc

SEQ ID NO: 704 - DNA, 50 bp, Artificial Sequence
  synthetic Elaeis guineensis (oil palm) single nucleotide polymorphism (SNP) in genomic region adjacent to shatterproof1 (SHELL) shell thickness gene
tggcattatcgaggaggaggttctytggcttgaggtcccagtggtagatg

SEQ ID NO: 705 - DNA, 50 bp, Artificial Sequence
  synthetic Elaeis guineensis (oil palm) single nucleotide polymorphism (SNP) in genomic region adjacent to shatterproof1 (SHELL) shell thickness gene
cttgaggtcccagtggtagatgccrcgtgcatggcagtatttgatggcgg

SEQ ID NO: 706 - DNA, 50 bp, Artificial Sequence
  synthetic Elaeis guineensis (oil palm) single nucleotide polymorphism (SNP) in genomic region adjacent to shatterproof1 (SHELL) shell thickness gene
gattcgttggcagaagtagcattgrgagaggtcctcaagagatggcctcg

SEQ ID NO: 707 - DNA, 50 bp, Artificial Sequence
  synthetic Elaeis guineensis (oil palm) single nucleotide polymorphism (SNP) in genomic region adjacent to shatterproof1 (SHELL) shell thickness gene
atgcatgcatagagcttgctattgyaggcgagcttgaggacgaagtagat

SEQ ID NO: 708 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcgagcttgaggacgaagtagatcwtggagcgggaagcgaggaccttaag

SEQ ID NO: 709 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcttggagcgggaagcgaggacctyaaggaagtgaaggatgtgggggtga

SEQ ID NO: 710 - DNA, 50 bp, Artificial Sequence
  synthetic Elaeis guineensis (oil palm) single nucleotide polymorphism (SNP) in genomic region adjacent to shatterproof1 (SHELL) shell thickness gene
agtgaaggatgtgggggtgatggargtggcgcattatggcgatcttgcgg

SEQ ID NO: 711 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagtggcgcattatggcgatcttgyggatgacattgtgggcatagccgcc

SEQ ID NO: 712 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggcccttggggatggccttgagagygatgctttgattagagtagaggttg

SEQ ID NO: 713 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccttggggatggccttgagagcgaygctttgattagagtagaggttgtga

SEQ ID NO: 714 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcatataattgtttaatgagccacrtgcagtcacgtgatagttatggaca

SEQ ID NO: 715 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttagccaaattggcaaacatgaaakttggatcacttgattgctaatatct

SEQ ID NO: 716 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaaatttggatcacttgattgctartatctctgaacttcattatacaaaa

SEQ ID NO: 717 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatctaacttacactacaacaaaayaagatattagcataaaaaaaaattc

SEQ ID NO: 718 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaatcaaatttaaaaaagcattagyggctaaaatttttcatcgcaaatat

SEQ ID NO: 719 - DNA, 50 bp, Artificial Sequence
  synthetic Elaeis guineensis (oil palm) single nucleotide polymorphism (SNP) in genomic region adjacent to shatterproof1 (SHELL) shell thickness gene
atcataatttctgacataaattttyatcactaataaatattaaattaata

SEQ ID NO: 720 - DNA, 50 bp, Artificial Sequence
  synthetic Elaeis guineensis (oil palm) single nucleotide polymorphism (SNP) in genomic region adjacent to shatterproof1 (SHELL) shell thickness gene
cactaataaatattaaattaataaygataaaaatattttcatcactatta

SEQ ID NO: 721 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggttatttacgatgaaaatattttwatcgctattaatttaattaaaaatt

SEQ ID NO: 722 - DNA, 50 bp, Artificial Sequence
  synthetic Elaeis guineensis (oil palm) single nucleotide polymorphism (SNP) in genomic region adjacent to shatterproof1 (SHELL) shell thickness gene
attaatttaattaaaaatttttatraaaatcaaatttagaaaaatattag

SEQ ID NO: 723 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaatcaaatttaaaaaatattagygatgtaaattttacatctcaaatat

SEQ ID NO: 724 - DNA, 50 bp, Artificial Sequence
  synthetic Elaeis guineensis (oil palm) single nucleotide polymorphism (SNP) in genomic region adjacent to shatterproof1 (SHELL) shell thickness gene
taaatttttatcgataataaatttktaattatttatgataaaaatatttt

SEQ ID NO: 725 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttttttatcgctaatatattttttracgaccaatatttcatcgaaaataa

SEQ ID NO: 726 - DNA, 50 bp, Artificial Sequence
  synthetic Elaeis guineensis (oil palm) single nucleotide polymorphism (SNP) in genomic region adjacent to shatterproof1 (SHELL) shell thickness gene
aataaatttataaataaattttatyattttattatattaaattaaaatta

SEQ ID NO: 727 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttttattatattaaattaaaattayaagagacctaaaataaaaataaaaa

SEQ ID NO: 728 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcatagatgtcagtcctgaatgagygtgaggatgaggtagcagtgatccc

SEQ ID NO: 729 - DNA, 50 bp, Artificial Sequence
  synthetic Elaeis guineensis (oil palm) single nucleotide polymorphism (SNP) in genomic region adjacent to shatterproof1 (SHELL) shell thickness gene
gatctcataccaagcacctgatcayaactctcgccatctgtgggtgcgat

SEQ ID NO: 730 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcacctgatcacaactctcgccatytgtgggtgcgatcgagccctctgga

SEQ ID NO: 731 - DNA, 50 bp, Artificial Sequence
  synthetic Elaeis guineensis (oil palm) single nucleotide polymorphism (SNP) in genomic region adjacent to shatterproof1 (SHELL) shell thickness gene
ataaagagctcctagcactccgtcrttcactcttttgatcgtcgctggtg

SEQ ID NO: 732 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaattggatgtataatctgatatgycggatccttgtaatatcggtatatg

SEQ ID NO: 733 - DNA, 50 bp, Artificial Sequence
  synthetic Elaeis guineensis (oil palm) single nucleotide polymorphism (SNP) in genomic region adjacent to shatterproof1 (SHELL) shell thickness gene
agtgatgctgtcatagggccgctgycgcattgcctccacctcatgatcct

SEQ ID NO: 734 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaaatacaaagataaatgagcatcyacagctcgctgcatgcgatcctcct

SEQ ID NO: 735 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccctatcaataacaaatattagaaraatactatactaattaaatattcac

SEQ ID NO: 736 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaagcgtcacggggcataactgcrgcatatgatgcccagcttgatctgc

SEQ ID NO: 737 - DNA, 50 bp, Artificial Sequence
  synthetic Elaeis guineensis (oil palm) single nucleotide polymorphism (SNP) in genomic region adjacent to shatterproof1 (SHELL) shell thickness gene
aactgcagcatatgatgcccagctygatctgccacagctcgtaccatctc

SEQ ID NO: 738 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggagacactatctcgggtactcgcrtctccaatactctaaagcgaggttc

SEQ ID NO: 739 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcacctcactaccggtggagactgrcctgaaacaataataaataaatcat

SEQ ID NO: 740 - DNA, 50 bp, Artificial Sequence
  synthetic Elaeis guineensis (oil palm) single nucleotide polymorphism (SNP) in genomic region adjacent to shatterproof1 (SHELL) shell thickness gene
catctttctcctggtgccatacctrcaattcttgacatataaatgaatat

SEQ ID NO: 741 - DNA, 50 bp, Artificial Sequence
  synthetic Elaeis guineensis (oil palm) single nucleotide polymorphism (SNP) in genomic region adjacent to shatterproof1 (SHELL) shell thickness gene
catataaatgaatataatattaaayaataataataaaaaataaattatat

SEQ ID NO: 742 - DNA, 50 bp, Artificial Sequence
  synthetic Elaeis guineensis (oil palm) single nucleotide polymorphism (SNP) in genomic region adjacent to shatterproof1 (SHELL) shell thickness gene
atcgcataccattattgcaagaaargattgaacaaagaatatagatctac

SEQ ID NO: 743 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctcatcgtcatttatgaactgatcrtcgtcctctgactcatcaagattaa

SEQ ID NO: 744 - DNA, 50 bp, Artificial Sequence
  synthetic Elaeis guineensis (oil palm) single nucleotide polymorphism (SNP) in genomic region adjacent to shatterproof1 (SHELL) shell thickness gene
gttagacggtagattagccctattyaaaggagtcattacaagttcttcat

SEQ ID NO: 745 - DNA, 50 bp, Artificial Sequence
  synthetic Elaeis guineensis (oil palm) single nucleotide polymorphism (SNP) in genomic region adjacent to shatterproof1 (SHELL) shell thickness gene
agattagccctatttaaaggagtcrttacaagttcttcatcaacaagaag

SEQ ID NO: 746 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaagcttcctcttcatgtaaatttraattttcatccatctctaatcgggt

SEQ ID NO: 747 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttgaattttcatccatctctaatygggttggtatgtcatatacacctct

SEQ ID NO: 748 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttcttaaatattttttttctaaaygagctccggactcggcttcccatag

SEQ ID NO: 749 - DNA, 50 bp, Artificial Sequence
  synthetic Elaeis guineensis (oil palm) single nucleotide polymorphism (SNP) in genomic region adjacent to shatterproof1 (SHELL) shell thickness gene
cggactcggcttcccatagcccccrctcccacggcgccggcgtcgtcaca

SEQ ID NO: 750 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatagttaatttatgattttttctycaaaaaaattatgtacataaaaaat

SEQ ID NO: 751 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctccaaaaaaattatgtacataamaaatataattttgatgaaaaattta

SEQ ID NO: 752 - DNA, 50 bp, Artificial Sequence
  synthetic Elaeis guineensis (oil palm) single nucleotide polymorphism (SNP) in genomic region adjacent to shatterproof1 (SHELL) shell thickness gene
caacttccgcaatggaataagcacyataggagatcgatagttttgaggtc

SEQ ID NO: 753 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcttcttcttggagtccctgttctrgaagtcggagtacttgaatgtcgcg

SEQ ID NO: 754 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagtcggagtacttgaatgtcgcgrtgattctgagatcgcgagagaaatc

SEQ ID NO: 755 - DNA, 50 bp, Artificial Sequence
  synthetic Elaeis guineensis (oil palm) single nucleotide polymorphism (SNP) in genomic region adjacent to shatterproof1 (SHELL) shell thickness gene
atgaaaatattgataaaataagaawtatcttttgtattgcgtctatctca

SEQ ID NO: 756 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctctctgaatccccgaagtaactgytgtccactgtccaggagctctactc

SEQ ID NO: 757 - DNA, 50 bp, Artificial Sequence
  synthetic Elaeis guineensis (oil palm) single nucleotide polymorphism (SNP) in genomic region adjacent to shatterproof1 (SHELL) shell thickness gene
tccccgaagtaactgctgtccactrtccaggagctctactccttctcttt

SEQ ID NO: 758 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagttatccgcgcaccacatcaaawgtcaggccacaccataacccttctg

SEQ ID NO: 759 - DNA, 50 bp, Artificial Sequence
  synthetic Elaeis guineensis (oil palm) single nucleotide polymorphism (SNP) in genomic region adjacent to shatterproof1 (SHELL) shell thickness gene
caggccacaccataacccttctgtycacggtcacagccttttaaaggctt

SEQ ID NO: 760 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagatgattaatataaaaaagcatrcctcataaactataaaatagactgt

SEQ ID NO: 761 - DNA, 50 bp, Artificial Sequence
  synthetic Elaeis guineensis (oil palm) single nucleotide polymorphism (SNP) in genomic region adjacent to shatterproof1 (SHELL) shell thickness gene
tataaaaaagcatgcctcataaacyataaaatagactgtttacaaataaa

SEQ ID NO: 762 - DNA, 50 bp, Artificial Sequence
  synthetic Elaeis guineensis (oil palm) single nucleotide polymorphism (SNP) in genomic region adjacent to shatterproof1 (SHELL) shell thickness gene
atttataataaaaaaatttcatcgyaaataataatcaatttttgattttt

SEQ ID NO: 763 - DNA, 50 bp, Artificial Sequence
  synthetic Elaeis guineensis (oil palm) single nucleotide polymorphism (SNP) in genomic region adjacent to shatterproof1 (SHELL) shell thickness gene
atttatgatgaaaataatattttcrtcataaaaaaagtcatttacgataa

SEQ ID NO: 764 - DNA, 50 bp, Artificial Sequence
  synthetic Elaeis guineensis (oil palm) single nucleotide polymorphism (SNP) in genomic region adjacent to shatterproof1 (SHELL) shell thickness gene
attgatgatcaaaatatttttaatrtaaataatctattatttatgatgaa

SEQ ID NO: 765 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaatatttttaatgtaaataatcyattatttatgatgaaaatcgatttt

SEQ ID NO: 766 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtttttgaaatattttaaatttctyattttttttctagatattgacgatg

SEQ ID NO: 767 - DNA, 50 bp, Artificial Sequence
  synthetic Elaeis guineensis (oil palm) single nucleotide polymorphism (SNP) in genomic region adjacent to shatterproof1 (SHELL) shell thickness gene
gccgacgaaaaaatatttttcatcrtaaataattaaattatttacgacga

SEQ ID NO: 768 - DNA, 50 bp, Artificial Sequence
  synthetic Elaeis guineensis (oil palm) single nucleotide polymorphism (SNP) in genomic region adjacent to shatterproof1 (SHELL) shell thickness gene
acgacgaaaatattttcatcgtgartattttaaaatttaaaattaaaata

SEQ ID NO: 769 - DNA, 50 bp, Artificial Sequence
  synthetic Elaeis guineensis (oil palm) single nucleotide polymorphism (SNP) in genomic region adjacent to shatterproof1 (SHELL) shell thickness gene
aataaataatatattatttacgatraaatatttatcataaataatttgta

SEQ ID NO: 770 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgcatgtcagcaaaaacttgcaatytaagacttaatgcgaagctgcggct

SEQ ID NO: 771 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggaagggtttatgaagaaagtaaasctattacgcatagcaagtaaaaaca

SEQ ID NO: 772 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggtttatgaagaaagtaaagctatyacgcatagcaagtaaaaacattatt

SEQ ID NO: 773 - DNA, 50 bp, Artificial Sequence
  synthetic Elaeis guineensis (oil palm) single nucleotide polymorphism (SNP) in genomic region adjacent to shatterproof1 (SHELL) shell thickness gene
catagcaagtaaaaacattatttgyttatcttttctcatgctacagcaca

SEQ ID NO: 774 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgctacagcacaagtaaaccaatgyaacatacatgcttcaaggggctgcc

SEQ ID NO: 775 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtattaacttaaaaaggaactaccmaaaaaatttacaatctagagagcag

SEQ ID NO: 776 - DNA, 50 bp, Artificial Sequence
  synthetic Elaeis guineensis (oil palm) single nucleotide polymorphism (SNP) in genomic region adjacent to shatterproof1 (SHELL) shell thickness gene
taaatgacagtggcaaattaaatgytaaagcgccatgctaattccagttc

SEQ ID NO: 777 - DNA, 50 bp, Artificial Sequence
  synthetic Elaeis guineensis (oil palm) single nucleotide polymorphism (SNP) in genomic region adjacent to shatterproof1 (SHELL) shell thickness gene
gataatcttcaataagatccagtgrcacaagtctttgtaggcataaatgt

SEQ ID NO: 778 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgttcaatagaaacaacaggcaatrgggtataaatacaagcacattagca

SEQ ID NO: 779 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatacaagcacattagcagctagayacagacaatattctgtgatacccta

SEQ ID NO: 780 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcaaatcaatgtgcaatttaaagcmagatgactgtgtcacatcccagaca

SEQ ID NO: 781 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctttacggggaagtaaaaaatacaycattcttttgaataaggtatttgtc

SEQ ID NO: 782 - DNA, 50 bp, Artificial Sequence
  synthetic Elaeis guineensis (oil palm) single nucleotide polymorphism (SNP) in genomic region adjacent to shatterproof1 (SHELL) shell thickness gene
taaaaaatacatcattcttttgaayaaggtatttgtcctcatattgctag

SEQ ID NO: 783 - DNA, 50 bp, Artificial Sequence
  synthetic Elaeis guineensis (oil palm) single nucleotide polymorphism (SNP) in genomic region adjacent to shatterproof1 (SHELL) shell thickness gene
agacgcattggggaaaaaaaaaaargtagctcagtgcacaaggcttcagc

SEQ ID NO: 784 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctcagtgcacaaggcttcagccackgtaaggtctgaagagactccagccc

SEQ ID NO: 785 - DNA, 50 bp, Artificial Sequence
  synthetic Elaeis guineensis (oil palm) single nucleotide polymorphism (SNP) in genomic region adjacent to shatterproof1 (SHELL) shell thickness gene
aggcttcagccacggtaaggtctgragagactccagccctacccctgcat

SEQ ID NO: 786 - DNA, 50 bp, Artificial Sequence
  synthetic Elaeis guineensis (oil palm) single nucleotide polymorphism (SNP) in genomic region adjacent to shatterproof1 (SHELL) shell thickness gene
agagactgtttccatatttcaaacwgtcacaatgggcaactttagcattg

SEQ ID NO: 787 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcggtccagctttatcttcagctcrgtacattgcccaaagaattttgcaa

SEQ ID NO: 788 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcatcaggaaccaaaagaaatggaraaaaaaatgaaaaggatggcactaa

SEQ ID NO: 789 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatatgaagccaataaggagatgarctacctctgcacacatcggatgcct

SEQ ID NO: 790 - DNA, 50 bp, Artificial Sequence
  synthetic Elaeis guineensis (oil palm) single nucleotide polymorphism (SNP) in genomic region adjacent to shatterproof1 (SHELL) shell thickness gene
tccaacattctaaattaagaatgakgcgaaaaaactatagaaactgaacc

SEQ ID NO: 791 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctgcaccaatttccaagcttaaggrccacatgaatgtgaagtttccctac

SEQ ID NO: 792 - DNA, 50 bp, Artificial Sequence
  synthetic Elaeis guineensis (oil palm) single nucleotide polymorphism (SNP) in genomic region adjacent to shatterproof1 (SHELL) shell thickness gene
atgaatgtgaagtttccctacactmtccatcctcaattgctatgttagag

SEQ ID NO: 793 - DNA, 50 bp, Artificial Sequence
  synthetic Elaeis guineensis (oil palm) single nucleotide polymorphism (SNP) in genomic region adjacent to shatterproof1 (SHELL) shell thickness gene
actatccatcctcaattgctatgtyagagaagcacttcaatggtcaatgt

SEQ ID NO: 794 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttgatccatttactgacaaaacaasgtatcagctctaaatccagtctgct

SEQ ID NO: 795 - DNA, 50 bp, Artificial Sequence
  synthetic Elaeis guineensis (oil palm) single nucleotide polymorphism (SNP) in genomic region adjacent to shatterproof1 (SHELL) shell thickness gene
aattaagatggatcatatcatgccrattcctaatctgtatccagtcatgc

SEQ ID NO: 796 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcatgccaattcctaatctgtatcyagtcatgctcaccatacaaatacat

SEQ ID NO: 797 - DNA, 50 bp, Artificial Sequence
  synthetic Elaeis guineensis (oil palm) single nucleotide polymorphism (SNP) in genomic region adjacent to shatterproof1 (SHELL) shell thickness gene
caggcataccaacagacataagtcstaatttcagttgacaaatgatattc

SEQ ID NO: 798 - DNA, 50 bp, Artificial Sequence
  synthetic Elaeis guineensis (oil palm) single nucleotide polymorphism (SNP) in genomic region adjacent to shatterproof1 (SHELL) shell thickness gene
atttccaaaaatgatccaccagagycattcactagcctaaattttgcttg

SEQ ID NO: 799 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaatatcttaattaagtttaatatsaaaaaaatagctattcaattttatc

SEQ ID NO: 800 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgcagtgctaccaactatgcattgycaaagggtctagtacttggattatc

SEQ ID NO: 801 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtgggctctaacttcttaagttgtygacacaagggtccaaaggtttaggt

SEQ ID NO: 802 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaggcattcatctttatattcatarcctacaaagcataattgcatctgta

SEQ ID NO: 803 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttggcatgtacatgattcttggtawgggaagggtggaaggcaagaatgaa

SEQ ID NO: 804 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtggaaggcaagaatgaaaatatgwgatttttttcatatagaactatggc

SEQ ID NO: 805 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccatgtaggaaacaagaaattcatkctaatgggactatagaagcatattc

SEQ ID NO: 806 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttatctattcattgcaagctgctrtatccacatttatctgtcagattaa

SEQ ID NO: 807 - DNA, 50 bp, Artificial Sequence
  synthetic Elaeis guineensis (oil palm) single nucleotide polymorphism (SNP) in genomic region adjacent to shatterproof1 (SHELL) shell thickness gene
tccctactaaagtcatattttgccygtgagcattaagtctcatgacctgt

SEQ ID NO: 808 - DNA, 50 bp, Artificial Sequence
  synthetic Elaeis guineensis (oil palm) single nucleotide polymorphism (SNP) in genomic region adjacent to shatterproof1 (SHELL) shell thickness gene
acgaactgaaagactatgaaaacamatcaaaatacgattgcaaccatata

SEQ ID NO: 809 - DNA, 50 bp, Artificial Sequence
  synthetic Elaeis guineensis (oil palm) single nucleotide polymorphism (SNP) in genomic region adjacent to shatterproof1 (SHELL) shell thickness gene
catcaccaacacgaagtgccagtayaaaaatagggagaattttttttttt

SEQ ID NO: 810 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcatcatacctatgatcttgaattyggatgagaagatcgaacaagaatac

SEQ ID NO: 811 - DNA, 50 bp, Artificial Sequence
  synthetic Elaeis guineensis (oil palm) single nucleotide polymorphism (SNP) in genomic region adjacent to shatterproof1 (SHELL) shell thickness gene
gatcttgaatttggatgagaagatmgaacaagaatacagggctttcagag

SEQ ID NO: 812 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgtcatcttgggctccatgccagcrtggaggccgaaatggggatgctgat

SEQ ID NO: 813 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtgacccaagccaaacctcagtctmaaccagacaaggaaacctgggaatc

SEQ ID NO: 814 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctcaaccagacaaggaaacctggraatctgggatattgatggaggattg

SEQ ID NO: 815 - DNA, 50 bp, Artificial Sequence
  synthetic Elaeis guineensis (oil palm) single nucleotide polymorphism (SNP) in genomic region adjacent to shatterproof1 (SHELL) shell thickness gene
accaagccatcaaaaggaaggccawagcctagaaatcgagaactgcaacc

SEQ ID NO: 816 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcgagaactgcaacccataacagasgactaatgaacctattgaacgacaa

SEQ ID NO: 817 - DNA, 50 bp, Artificial Sequence
  synthetic Elaeis guineensis (oil palm) single nucleotide polymorphism (SNP) in genomic region adjacent to shatterproof1 (SHELL) shell thickness gene
acaatcaaaatttaacattaattckccatgttttctttgaagcagataaa

SEQ ID NO: 818 - DNA, 50 bp, Artificial Sequence
  synthetic Elaeis guineensis (oil palm) single nucleotide polymorphism (SNP) in genomic region adjacent to shatterproof1 (SHELL) shell thickness gene
aggagcgtccgccagctttgattgkagaacggcgaccggcgacggcacga

SEQ ID NO: 819 - DNA, 50 bp, Artificial Sequence
  synthetic Elaeis guineensis (oil palm) single nucleotide polymorphism (SNP) in genomic region adjacent to shatterproof1 (SHELL) shell thickness gene
attcagggagaaggctctcgcacgkgatcgaagacaaagagtagggagag

SEQ ID NO: 820 - DNA, 50 bp, Artificial Sequence
  synthetic Elaeis guineensis (oil palm) single nucleotide polymorphism (SNP) in genomic region adjacent to shatterproof1 (SHELL) shell thickness gene
tggcgtcaaagtccccttttttttwcgattttttccgcgattcatgtatc

SEQ ID NO: 821 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggcgtcaaagtcccctttttttttmgattttttccgcgattcatgtatcg

SEQ ID NO: 822 - DNA, 50 bp, Artificial Sequence
  synthetic Elaeis guineensis (oil palm) single nucleotide polymorphism (SNP) in genomic region adjacent to shatterproof1 (SHELL) shell thickness gene
tattcctgttttacctgaattccgsatcgctggatttgtacgcgtgtgaa

SEQ ID NO: 823 - DNA, 50 bp, Artificial Sequence
  synthetic Elaeis guineensis (oil palm) single nucleotide polymorphism (SNP) in genomic region adjacent to shatterproof1 (SHELL) shell thickness gene
tccctgcagactccatatctgaaaytccaggggatgaaaacttgagtagg

SEQ ID NO: 824 - DNA, 50 bp, Artificial Sequence
  synthetic Elaeis guineensis (oil palm) single nucleotide polymorphism (SNP) in genomic region adjacent to shatterproof1 (SHELL) shell thickness gene
tacatccctcggtactatatttctyttttttttctatacagaaaatgttc

SEQ ID NO: 825 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtgtaaaatcaggccttaatgcttytgttgggaaggaatcctcacgagtg

SEQ ID NO: 826 - DNA, 50 bp, Artificial Sequence
  synthetic Elaeis guineensis (oil palm) single nucleotide polymorphism (SNP) in genomic region adjacent to shatterproof1 (SHELL) shell thickness gene
cttaatgcttctgttgggaaggaaycctcacgagtgtggaatacggatcc

SEQ ID NO: 827 - DNA, 50 bp, Artificial Sequence
  synthetic Elaeis guineensis (oil palm) single nucleotide polymorphism (SNP) in genomic region adjacent to shatterproof1 (SHELL) shell thickness gene
atctaagatcgctaattcaggtgayggtgtcaataccgcaataagaagaa

SEQ ID NO: 828 - DNA, 50 bp, Artificial Sequence
  synthetic Elaeis guineensis (oil palm) single nucleotide polymorphism (SNP) in genomic region adjacent to shatterproof1 (SHELL) shell thickness gene
cacctctgatcgttcaatcacgacygcaagctcttctgaccttcagattg

SEQ ID NO: 829 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaccgcaagctcttctgaccttcarattgcgcaaaacaatgcatgaaccg

SEQ ID NO: 830 - DNA, 50 bp, Artificial Sequence
  synthetic Elaeis guineensis (oil palm) single nucleotide polymorphism (SNP) in genomic region adjacent to shatterproof1 (SHELL) shell thickness gene
caagctcttctgaccttcagattgygcaaaacaatgcatgaaccgcgcat

SEQ ID NO: 831 - DNA, 50 bp, Artificial Sequence
  synthetic Elaeis guineensis (oil palm) single nucleotide polymorphism (SNP) in genomic region adjacent to shatterproof1 (SHELL) shell thickness gene
accgcggcggtccacgcgcgatgcrtggactgcgacttcctgtggatgcg

SEQ ID NO: 832 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaccgtgctgtgcaccatgtgggcrcgctagtctgggctgagcatgtcca

SEQ ID NO: 833 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgcgttgtagcgagcttgggcggcytgcgggcctacgagccacgcttgta

SEQ ID NO: 834 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgtaggcttgccgcctgtgtctacrtgcctatggggctggacttctcttt

SEQ ID NO: 835 - DNA, 50 bp, Artificial Sequence
  synthetic Elaeis guineensis (oil palm) single nucleotide polymorphism (SNP) in genomic region adjacent to shatterproof1 (SHELL) shell thickness gene
attcaacaatctccacctcgactcracattcggccttcacctaactttaa

SEQ ID NO: 836 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttcacctaactttaagaacttctakatcatcttgcccccatgtcttgggg

SEQ ID NO: 837 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcccccatgtcttggggcaaatgtytggctgctcatggatgggcaaacat

SEQ ID NO: 838 - DNA, 50 bp, Artificial Sequence
  synthetic Elaeis guineensis (oil palm) single nucleotide polymorphism (SNP) in genomic region adjacent to shatterproof1 (SHELL) shell thickness gene
gctgctcatggatgggcaaacatgrgagtcgagccagaccgctcgatacc

SEQ ID NO: 839 - DNA, 50 bp, Artificial Sequence
  synthetic Elaeis guineensis (oil palm) single nucleotide polymorphism (SNP) in genomic region adjacent to shatterproof1 (SHELL) shell thickness gene
agatctgatcggggtagcctcctgyagtaatagaaacttcattctgcgat

SEQ ID NO: 840 - DNA, 50 bp, Artificial Sequence
  synthetic Elaeis guineensis (oil palm) single nucleotide polymorphism (SNP) in genomic region adjacent to shatterproof1 (SHELL) shell thickness gene
atctgatcggggtagcctcctgcartaatagaaacttcattctgcgatgt

SEQ ID NO: 841 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttcgtctcatgcccaatccatctgyatctggagctccacctcgttctgag

SEQ ID NO: 842 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagctctacctcatgctgagctctytgtcaagaggtaatgttctccatac

SEQ ID NO: 843 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcttccctttcatcacaatcctacygtcgtgcaagactttaggatttttt

SEQ ID NO: 844 - DNA, 50 bp, Artificial Sequence
  synthetic Elaeis guineensis (oil palm) single nucleotide polymorphism (SNP) in genomic region adjacent to shatterproof1 (SHELL) shell thickness gene
actgctccatcaaatatctgtaagytgacaatctcaatgcccttgatcgc

SEQ ID NO: 845 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagtagatacctcatcaatcaccaraagaacattatcactatcttctgta

SEQ ID NO: 846 - DNA, 50 bp, Artificial Sequence
  synthetic Elaeis guineensis (oil palm) single nucleotide polymorphism (SNP) in genomic region adjacent to shatterproof1 (SHELL) shell thickness gene
gctatgggcaatctctgactcgatrccccaactcatcatacctgtaacac

SEQ ID NO: 847 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctatgggcaatctctgactcgatgycccaactcatcatacctgtaacacc

SEQ ID NO: 848 - DNA, 50 bp, Artificial Sequence
  synthetic Elaeis guineensis (oil palm) single nucleotide polymorphism (SNP) in genomic region adjacent to shatterproof1 (SHELL) shell thickness gene
cctgtaacacctgatcttgctgtartccctcgatttggatttggaccgcc

SEQ ID NO: 849 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtcactgccattgccgagtcatcayctgaactcgaagctcagttcttcca

SEQ ID NO: 850 - DNA, 50 bp, Artificial Sequence
  synthetic Elaeis guineensis (oil palm) single nucleotide polymorphism (SNP) in genomic region adjacent to shatterproof1 (SHELL) shell thickness gene
cttccatctgagaacctcattctgragaagtgtagaagtgacttctttca

SEQ ID NO: 851 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaaactcaaaaggaaaaaaaagtratgaaggcaagaccaatgccttggt

SEQ ID NO: 852 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcaaaaggaaaaaaaagtaatgaargcaagaccaatgccttggtcttctc

SEQ ID NO: 853 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaaagttgctgagatgctcctgcaygctttgtccctcactcatctgcagc

SEQ ID NO: 854 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctgcagctgatagaactgctttcaragaaagagagcgttggtgagtgact

SEQ ID NO: 855 - DNA, 50 bp, Artificial Sequence
  synthetic Elaeis guineensis (oil palm) single nucleotide polymorphism (SNP) in genomic region adjacent to shatterproof1 (SHELL) shell thickness gene
catctcgagcttcatccacatcgcyatcgaagaagtgtcgctaagcatat

SEQ ID NO: 856 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaaaataaatacaagaggagatcrcacactttcaactctcataaacttt

SEQ ID NO: 857 - DNA, 50 bp, Artificial Sequence
  synthetic Elaeis guineensis (oil palm) single nucleotide polymorphism (SNP) in genomic region adjacent to shatterproof1 (SHELL) shell thickness gene
agaacccctaagtagaccctctacrgctccctctgcttcacgggttgctc

SEQ ID NO: 858 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaattttatcaggactcaaaaaaaygtctgaccatccgatcatgaccgca

SEQ ID NO: 859 - DNA, 50 bp, Artificial Sequence
  synthetic Elaeis guineensis (oil palm) single nucleotide polymorphism (SNP) in genomic region adjacent to shatterproof1 (SHELL) shell thickness gene
aattttatcaggactcaaaaaaatstctgaccatccgatcatgaccgcaa

SEQ ID NO: 860 - DNA, 50 bp, Artificial Sequence
  synthetic Elaeis guineensis (oil palm) single nucleotide polymorphism (SNP) in genomic region adjacent to shatterproof1 (SHELL) shell thickness gene
atgaccgcaagctctcctgaccctyagatcgtgcaaaacaatgcatgaac

SEQ ID NO: 861 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcactcgtccgtgcgcacgtgagcmgcaataaaccctctgtagaccgccg

SEQ ID NO: 862 - DNA, 50 bp, Artificial Sequence
  synthetic Elaeis guineensis (oil palm) single nucleotide polymorphism (SNP) in genomic region adjacent to shatterproof1 (SHELL) shell thickness gene
cacgtgagccgcaataaaccctctrtagaccgccgcagtccatgcgcggc

SEQ ID NO: 863 - DNA, 50 bp, Artificial Sequence
  synthetic Elaeis guineensis (oil palm) single nucleotide polymorphism (SNP) in genomic region adjacent to shatterproof1 (SHELL) shell thickness gene
cgtgcgcctatgcgcgtgggccgcrcgctggataggtcgcccacgctgtg

SEQ ID NO: 864 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgggtgcctgcaagccgggcctacrggctgcacctgtaggcctacttcct

SEQ ID NO: 865 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggctactttgggtcgaattcgaggygccaaaactcaacagcttcatcatt

SEQ ID NO: 866 - DNA, 50 bp, Artificial Sequence
  synthetic Elaeis guineensis (oil palm) single nucleotide polymorphism (SNP) in genomic region adjacent to shatterproof1 (SHELL) shell thickness gene
atacctaccattaatctaaaaccaycagtctggaaagaagaatttggagg

SEQ ID NO: 867 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttggaggtcaccttgaagaaaggayaatcagaggaattgtttgttgatgt

SEQ ID NO: 868 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtgtgactttagtgtgaacagaatycaagagcatgtagaaataaggaaga

SEQ ID NO: 869 - DNA, 50 bp, Artificial Sequence
  synthetic Elaeis guineensis (oil palm) single nucleotide polymorphism (SNP) in genomic region adjacent to shatterproof1 (SHELL) shell thickness gene
gagacctttgtgagtcgcatgcatygcatgtccctgtctaataatttgtg

SEQ ID NO: 870 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaatcttgattcattgtttttgatytctatagatttctccctttttcttt

SEQ ID NO: 871 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaaaacacataggctagcttattmaaaaagatccaattgagttcatgga

SEQ ID NO: 872 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtaaaggttgctaagaaatctgtcragacatttgcttgccatccatgatc

SEQ ID NO: 873 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtcttcaggattgagaacttgatcrtcaattgatggtaatgttatgggtg

SEQ ID NO: 874 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctgcatctcattcatttctccctrtctgaacatatctttcttccgaaag

SEQ ID NO: 875 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatcactactttctgtacctggttmttttgctgacactgactcatgcacc

SEQ ID NO: 876 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctgtgatgcggaactaagcatgatmtatatggccctttctggcttaagcc

SEQ ID NO: 877 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatgattgggtaatgatgttttacwtgctttttgacgcccatgcatctgt

SEQ ID NO: 878 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgctagtggggtctgctgtttggcrcttaaacatcagaagatagaccaaa

SEQ ID NO: 879 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttatcagggaccagagtaaataayataggtactagtagtgacagaatat

SEQ ID NO: 880 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttccttacatagggatcaatcatygatgttttagctgatatcagccatt

SEQ ID NO: 881 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggtcagctttactgggcaatgtttytcccagggtatctttcatgttttta

SEQ ID NO: 882 - DNA, 50 bp, Artificial Sequence
  synthetic Elaeis guineensis (oil palm) single nucleotide polymorphism (SNP) in genomic region adjacent to shatterproof1 (SHELL) shell thickness gene
actagttaccatttttcactatgtraaattgtctctcactctgccagcct

SEQ ID NO: 883 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtcctggtcaatcgtgtcattttcrgtatggctgtaatcaggttccatga

SEQ ID NO: 884 - DNA, 50 bp, Artificial Sequence
  synthetic Elaeis guineensis (oil palm) single nucleotide polymorphism (SNP) in genomic region adjacent to shatterproof1 (SHELL) shell thickness gene
tggtttcattactgagacaagtctstactcacgaaaaaatgatgtgattt

SEQ ID NO: 885 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttttgttaatgtttttgccatggarattatggaaatgggttagggaagtt

SEQ ID NO: 886 - DNA, 50 bp, Artificial Sequence
  synthetic Elaeis guineensis (oil palm) single nucleotide polymorphism (SNP) in genomic region adjacent to shatterproof1 (SHELL) shell thickness gene
cttcatcttgttgcctctagtataygcctttttaatatcatttaatcact

SEQ ID NO: 887 - DNA, 50 bp, Artificial Sequence
  synthetic Elaeis guineensis (oil palm) single nucleotide polymorphism (SNP) in genomic region adjacent to shatterproof1 (SHELL) shell thickness gene
atgtatatatgtatatatgcatgcrtgcgtgcatgtgtgtacatatataa

SEQ ID NO: 888 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatatgcatgcatgcgtgcatgtgygtacatatataataggattggacgg

SEQ ID NO: 889 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaaatcacagaaaagccctcaatrgaaaaacactctctttccattacag

SEQ ID NO: 890 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctctctttccattacaggcccaacwcaagtatggcctaacaaaaactctt

SEQ ID NO: 891 - DNA, 50 bp, Artificial Sequence
  synthetic Elaeis guineensis (oil palm) single nucleotide polymorphism (SNP) in genomic region adjacent to shatterproof1 (SHELL) shell thickness gene
agttatgatttcctcatccctagtrtagcaaaacaaactagtagaaacct

SEQ ID NO: 892 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaccttgggcaacgcatgaaatakagccaagaaatataagaacgtgttt

SEQ ID NO: 893 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatttgaattattttggtggacaamaattagagaagagatgagactactc

SEQ ID NO: 894 - DNA, 50 bp, Artificial Sequence
  synthetic Elaeis guineensis (oil palm) single nucleotide polymorphism (SNP) in genomic region adjacent to shatterproof1 (SHELL) shell thickness gene
cacatgttgtaaagcaactaaacawaacttttccaatatttacaaaagca

SEQ ID NO: 895 - DNA, 50 bp, Artificial Sequence
  synthetic Elaeis guineensis (oil palm) single nucleotide polymorphism (SNP) in genomic region adjacent to shatterproof1 (SHELL) shell thickness gene
catgtccaatgggagtatttggacrggggttagcatcatctggctgcctg

SEQ ID NO: 896 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttggacaggggttagcatcatctgrctgcctgcatgtaagtcaatatgta

SEQ ID NO: 897 - DNA, 50 bp, Artificial Sequence
  synthetic Elaeis guineensis (oil palm) single nucleotide polymorphism (SNP) in genomic region adjacent to shatterproof1 (SHELL) shell thickness gene
attacataaacaattatcatcagcrgcagcgcatcttctcattcatgata

SEQ ID NO: 898 - DNA, 50 bp, Artificial Sequence
  synthetic Elaeis guineensis (oil palm) single nucleotide polymorphism (SNP) in genomic region adjacent to shatterproof1 (SHELL) shell thickness gene
tattgagattcgttatatttatcgrgaggtcaatagctctactgactgga

SEQ ID NO: 899 - DNA, 50 bp, Artificial Sequence
  synthetic Elaeis guineensis (oil palm) single nucleotide polymorphism (SNP) in genomic region adjacent to shatterproof1 (SHELL) shell thickness gene
atttatcgagaggtcaatagctctrctgactggatgatcttttatgtgac

SEQ ID NO: 900 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaaaaataaagtgacatgtggccyggcacaaagtcacgtgaccttgaat

SEQ ID NO: 901 - DNA, 50 bp, Artificial Sequence
  synthetic Elaeis guineensis (oil palm) single nucleotide polymorphism (SNP) in genomic region adjacent to shatterproof1 (SHELL) shell thickness gene
tccaacaagcattttagattataarcttacaccatgggcgagggaagttt

SEQ ID NO: 902 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctggtcaattttattaaaatgtaytgttccaatattaaaattttctcga

SEQ ID NO: 903 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtgttcctttgatctaaaaacagtmtaattttttgctaccacaaatatac

SEQ ID NO: 904 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttctttacagaaaaaactcacggasaataagcttaaatcttcatggccag

SEQ ID NO: 905 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatatcgatggtcccggaggagtcytgatttagtacataacttctaaatg

SEQ ID NO: 906 - DNA, 50 bp, Artificial Sequence
  synthetic Elaeis guineensis (oil palm) single nucleotide polymorphism (SNP) in genomic region adjacent to shatterproof1 (SHELL) shell thickness gene
acatagcatagcatttaccataaaraaccatgcatcgttacgtcatccaa

SEQ ID NO: 907 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaagtcttatgtatgctaagttttycctttagaatacttggaaggcttga

SEQ ID NO: 908 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgttcatgcaattaagttaccttgmcatatgtgatgcattaattacatgc

SEQ ID NO: 909 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtgtaaatattaattgttcttatgyattattgcttttcttagtgtttttc

SEQ ID NO: 910 - DNA, 50 bp, Artificial Sequence
  synthetic Elaeis guineensis (oil palm) single nucleotide polymorphism (SNP) in genomic region adjacent to shatterproof1 (SHELL) shell thickness gene
caataccataggtatttgttcttgytagccataaaaatatacaagcatat

SEQ ID NO: 911 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggtatttgttcttgctagccataamaatatacaagcatatgagggtagca

SEQ ID NO: 912 - DNA, 50 bp, Artificial Sequence
  synthetic Elaeis guineensis (oil palm) single nucleotide polymorphism (SNP) in genomic region adjacent to shatterproof1 (SHELL) shell thickness gene
tggtgatgatgttatccataacctwatcaataatttggttttgattttct

SEQ ID NO: 913 - DNA, 50 bp, Artificial Sequence
  synthetic Elaeis guineensis (oil palm) single nucleotide polymorphism (SNP) in genomic region adjacent to shatterproof1 (SHELL) shell thickness gene
atgtacgtgggtagaagggacagckttaacatgaaacatgtggaagtttt

SEQ ID NO: 914 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctatttatagatgaaagaaatgaawagaaagaaaaactttaaaagaaaga

SEQ ID NO: 915 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttatagatgaaagaaatgaaaagamagaaaaactttaaaagaaagaaaaa

SEQ ID NO: 916 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaaaactttaaaatacaccgcaaygattaatttcttattcaccatgtca

SEQ ID NO: 917 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatacaccgcaacgattaatttctyattcaccatgtcacctcttctatga

SEQ ID NO: 918 - DNA, 50 bp, Artificial Sequence
  synthetic Elaeis guineensis (oil palm) single nucleotide polymorphism (SNP) in genomic region adjacent to shatterproof1 (SHELL) shell thickness gene
acattttatatcgaagatatagtarcacaaactccatccggcggtacagc

SEQ ID NO: 919 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctctttaagaggaaacccacatatycgatgccaattgcatgcagtggaaa

SEQ ID NO: 920 - DNA, 50 bp, Artificial Sequence
  synthetic Elaeis guineensis (oil palm) single nucleotide polymorphism (SNP) in genomic region adjacent to shatterproof1 (SHELL) shell thickness gene
gctcccttcttttccctcggaattygcggtgttggacttcaccttctctt

SEQ ID NO: 921 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatccatttgtcatgatcttgtctmatgaatatatgtattctgttcttgt

SEQ ID NO: 922 - DNA, 50 bp, Artificial Sequence
  synthetic Elaeis guineensis (oil palm) single nucleotide polymorphism (SNP) in genomic region of shatterproof1 (SHELL) shell thickness gene
tctgcaaacgccgaaatggactgcygaagaatgcttatgagttgtctgtc

SEQ ID NO: 923 - DNA, 50 bp, Artificial Sequence
  synthetic Elaeis guineensis (oil palm) single nucleotide polymorphism (SNP) in genomic region of shatterproof1 (SHELL) shell thickness gene
acgccgaaatggactgctgaagaawgcttatgagttgtctgtcctttgtg

SEQ ID NO: 924 - DNA, 50 bp, Artificial Sequence
  synthetic Elaeis guineensis (oil palm) single nucleotide polymorphism (SNP) in genomic region adjacent to shatterproof1 (SHELL) shell thickness gene
agaatgttaatgatggtagttttgstcctcttcaatttatttgcttccct

SEQ ID NO: 925 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctcccaccctgtgcaactaattccsacaaaataagggtctcccattgtta

SEQ ID NO: 926 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgtgcctcatgacgagcattacctwtccatggttctgacacgacattgca

SEQ ID NO: 927 - DNA, 50 bp, Artificial Sequence
  synthetic Elaeis guineensis (oil palm) single nucleotide polymorphism (SNP) in genomic region adjacent to shatterproof1 (SHELL) shell thickness gene
catggttctgacacgacattgcatmctagattttactgtgtacgtaaaaa

SEQ ID NO: 928 - DNA, 50 bp, Artificial Sequence
  synthetic Elaeis guineensis (oil palm) single nucleotide polymorphism (SNP) in genomic region adjacent to shatterproof1 (SHELL) shell thickness gene
acacgacattgcatactagattttwctgtgtacgtaaaaaagcactgcat

SEQ ID NO: 929 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggactaagtttaaacatataaaaayatttaaattttgaaatatatatgta

SEQ ID NO: 930 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatggattgggtctggttgggtcartgcgagtctgcttaaatatatatat

SEQ ID NO: 931 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatatatatatacatatgggctagrtcaaatcaggttagtttatatatat

SEQ ID NO: 932 - DNA, 50 bp, Artificial Sequence
  synthetic Elaeis guineensis (oil palm) single nucleotide polymorphism (SNP) in genomic region adjacent to shatterproof1 (SHELL) shell thickness gene
caaaatttttgcaagcattcaagtrgacacaaatcaaagggcactaatgc

SEQ ID NO: 933 - DNA, 50 bp, Artificial Sequence
  synthetic Elaeis guineensis (oil palm) single nucleotide polymorphism (SNP) in genomic region adjacent to shatterproof1 (SHELL) shell thickness gene
taaaaatagcatgcattttatgaakataaccttactattattaggtaata

SEQ ID NO: 934 - DNA, 50 bp, Artificial Sequence
  synthetic Elaeis guineensis (oil palm) single nucleotide polymorphism (SNP) in genomic region adjacent to shatterproof1 (SHELL) shell thickness gene
cgagatggagagaaagcacttcatytctcatctttcctctctaaataaca

SEQ ID NO: 935 - DNA, 50 bp, Artificial Sequence
  synthetic Elaeis guineensis (oil palm) single nucleotide polymorphism (SNP) in genomic region adjacent to shatterproof1 (SHELL) shell thickness gene
agaaagcacttcatctctcatcttycctctctaaataacatttcactaag

SEQ ID NO: 936 - DNA, 50 bp, Artificial Sequence
  synthetic Elaeis guineensis (oil palm) single nucleotide polymorphism (SNP) in genomic region adjacent to shatterproof1 (SHELL) shell thickness gene
taccatttctcatatgaaaaaaaayattatctaagaagaataaattatta

SEQ ID NO: 937 - DNA, 50 bp, Artificial Sequence
  synthetic Elaeis guineensis (oil palm) single nucleotide polymorphism (SNP) in genomic region adjacent to shatterproof1 (SHELL) shell thickness gene
cttgtttgctattataaacccatgwcaacaatcaatatgcactaaagttt

SEQ ID NO: 938 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaaagtaaggaaaattgcttgaatratttagaagtgcataaatataatct

SEQ ID NO: 939 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaggagtcttatttatattttgagrattagaaagggggagaaaattgaac

SEQ ID NO: 940 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaacaaaactttgataaattgattrtaagaattttcaaaccttaaagcga

SEQ ID NO: 941 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaggttatctatattcattaatatyatttttttaaattattgtatatatt

SEQ ID NO: 942 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttctttaaaagttagattggtttcrtacttatcataaatgataaatgatc

SEQ ID NO: 943 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctttaaaagttagattggtttcgtmcttatcataaatgataaatgatctg

SEQ ID NO: 944 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaattatttgacatataacctttkataagaaattacatattaggatttt

SEQ ID NO: 945 - DNA, 50 bp, Artificial Sequence
  synthetic Elaeis guineensis (oil palm) single nucleotide polymorphism (SNP) in genomic region adjacent to shatterproof1 (SHELL) shell thickness gene
atattaggattttatggtttactgycatatagttctttgttttgtattta

SEQ ID NO: 946 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgatggcttatgatttttatttttyataacatttatttttatctataata

SEQ ID NO: 947 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttaatgaaagtggattacacgacayctaacttatatttttgaaaatagag

SEQ ID NO: 948 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttttaaaatttaaatgtcataggkttgaaaaattcttacttgtaaatat

SEQ ID NO: 949 - DNA, 50 bp, Artificial Sequence
  synthetic Elaeis guineensis (oil palm) single nucleotide polymorphism (SNP) in genomic region adjacent to shatterproof1 (SHELL) shell thickness gene
acacttagattgtgattgttgtttrgcattggaagatcgagacaattaat

SEQ ID NO: 950 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttaataccataagtgggatatatasttgcttaacccaacattaaaccaaa

SEQ ID NO: 951 - DNA, 50 bp, Artificial Sequence
  synthetic Elaeis guineensis (oil palm) single nucleotide polymorphism (SNP) in genomic region adjacent to shatterproof1 (SHELL) shell thickness gene
atacttgcttaacccaacattaaaycaaaatcacctctcgacaatcacac

SEQ ID NO: 952 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtgtactcaagataaacatggattrtcaagatatatataagaataataaa

SEQ ID NO: 953 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttgtttttaatttaatcctttgtyttcttaaatgactcagcttgtaatt

SEQ ID NO: 954 - DNA, 50 bp, Artificial Sequence
  synthetic Elaeis guineensis (oil palm) single nucleotide polymorphism (SNP) in genomic region adjacent to shatterproof1 (SHELL) shell thickness gene
atcctttgtcttcttaaatgactcrgcttgtaatttaaatatatcattac

SEQ ID NO: 955 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcagtaatgtccatttgttgtaaayaaatatttggcaatagaagaaatac

SEQ ID NO: 956 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccatttgttgtaaataaatatttgrcaatagaagaaatactataaggtca

SEQ ID NO: 957 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttcgtatagtctattataaatgtmgaatgaaacataataggcttttcat

SEQ ID NO: 958 - DNA, 50 bp, Artificial Sequence
  synthetic Elaeis guineensis (oil palm) single nucleotide polymorphism (SNP) in genomic region adjacent to shatterproof1 (SHELL) shell thickness gene
aattatcaaatatcaaaattaatgyaccaatttatgagacatcaatatta

SEQ ID NO: 959 - DNA, 50 bp, Artificial Sequence
  synthetic Elaeis guineensis (oil palm) single nucleotide polymorphism (SNP) in genomic region adjacent to shatterproof1 (SHELL) shell thickness gene
agacatcaatattataaagggataytaagaaactaacgagagtacactga

SEQ ID NO: 960 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctaagaaactaacgagagtacactratcaagaaatgtgatcgaccagtga

SEQ ID NO: 961 - DNA, 50 bp, Artificial Sequence
  synthetic Elaeis guineensis (oil palm) single nucleotide polymorphism (SNP) in genomic region adjacent to shatterproof1 (SHELL) shell thickness gene
atcgaccagtgaggcatgttgtttrtaaattaattagacacgttttcaat

SEQ ID NO: 962 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaggcatgttgtttataaattaatyagacacgttttcaatttatgagaat

SEQ ID NO: 963 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttataattgataaatggatcactwtttatttgctctttatatttagact

SEQ ID NO: 964 - DNA, 50 bp, Artificial Sequence
  synthetic Elaeis guineensis (oil palm) single nucleotide polymorphism (SNP) in genomic region adjacent to shatterproof1 (SHELL) shell thickness gene
attttcattaccataaaaaaagatygaaaataaaattaagaaagaatgag

SEQ ID NO: 965 - DNA, 50 bp, Artificial Sequence
  synthetic Elaeis guineensis (oil palm) single nucleotide polymorphism (SNP) in genomic region adjacent to shatterproof1 (SHELL) shell thickness gene
gataagtttgataattttagacatycgcttgcataatagttcatgtttaa

SEQ ID NO: 966 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttcatgtttaatattaatttatcaytgagaatgcaaaaatatataaaatt

SEQ ID NO: 967 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttaatttatcactgagaatgcaaamatatataaaatttttaattaagctt

SEQ ID NO: 968 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaataataaattaaactaagaaaayaaaaaatatttaataacaattggaa

SEQ ID NO: 969 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatgcatggaatgatttcataaatrttgcattgtactaaaagaatttatg

SEQ ID NO: 970 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttattatactttacaatagtaaacwaccttttgagcaaaatggtggtaac

SEQ ID NO: 971 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttatactttacaatagtaaactacyttttgagcaaaatggtggtaaccca

SEQ ID NO: 972 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctagataaagaagggggacagaaaragagatatagggctcccgagcttaa

SEQ ID NO: 973 - DNA, 50 bp, Artificial Sequence
  synthetic Elaeis guineensis (oil palm) single nucleotide polymorphism (SNP) in genomic region adjacent to shatterproof1 (SHELL) shell thickness gene
gataaagaagggggacagaaagagrgatatagggctcccgagcttaagca

SEQ ID NO: 974 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagagagatatagggctcccgagcytaagcaaccaagcaattcaatatag

SEQ ID NO: 975 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccgagcttaagcaaccaagcaattyaatatagttgcaaccaataaaatcc

SEQ ID NO: 976 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatatagttgcaaccaataaaatcygatatgagcaaatataaatataact

SEQ ID NO: 977 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatataaatataactcactaaaagyccaaaatacacccaataagcccagg

SEQ ID NO: 978 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaagcccaaaatacacccaataagsccaggtaaccactagcccaaacata

SEQ ID NO: 979 - DNA, 50 bp, Artificial Sequence
  synthetic Elaeis guineensis (oil palm) single nucleotide polymorphism (SNP) in genomic region adjacent to shatterproof1 (SHELL) shell thickness gene
cctctaccttccaagctctaattaytttaatgccattgcaaatcatcatg

SEQ ID NO: 980 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcttcttctaatttggtgtactatyattttcaatgtattgcaactctatt

SEQ ID NO: 981 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctaatttggtgtactatcattttyaatgtattgcaactctattgccaat

SEQ ID NO: 982 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttgccaatcgatgctcctccaaggyatctctcaagatctcatttggctct

SEQ ID NO: 983 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcaagatctcatttggctctattgygctaccactaccatccatcctatta

SEQ ID NO: 984 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctagatcaatatcaaaattaatgyagctcttttctcgatactttttgca

SEQ ID NO: 985 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcaatgtccatgcccatcttccatraaagctacttggcaaacaatcctaa

SEQ ID NO: 986 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaaagctacttggcaaacaatcctmataggttccaaaaaaccccacagct

SEQ ID NO: 987 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaccccacagctaaggactaaacayacaaccacacaggttctcttatact

SEQ ID NO: 988 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctaaacacacaaccacacaggttcwcttatactctctttatttagattca

SEQ ID NO: 989 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctagtcaaactgaatcataaacaycataatcaatccatggtcaactcca

SEQ ID NO: 990 - DNA, 50 bp, Artificial Sequence
  synthetic Elaeis guineensis (oil palm) single nucleotide polymorphism (SNP) in genomic region adjacent to shatterproof1 (SHELL) shell thickness gene
tggtcaactccaaccatttatgaarcataagatcttatctaaaaaaaatc

SEQ ID NO: 991 - DNA, 50 bp, Artificial Sequence
  synthetic Elaeis guineensis (oil palm) single nucleotide polymorphism (SNP) in genomic region adjacent to shatterproof1 (SHELL) shell thickness gene
atcaaataaaatacatgcttgtgcrgagatcctcacaaaaatatttagca

SEQ ID NO: 992 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcaaataaaatacatgcttgtgcgragatcctcacaaaaatatttagcaa

SEQ ID NO: 993 - DNA, 50 bp, Artificial Sequence
  synthetic Elaeis guineensis (oil palm) single nucleotide polymorphism (SNP) in genomic region adjacent to shatterproof1 (SHELL) shell thickness gene
caaaaattaaaagtataagatgaayatagaattgatgaataaagaaccaa

SEQ ID NO: 994 - DNA, 50 bp, Artificial Sequence
  synthetic Elaeis guineensis (oil palm) single nucleotide polymorphism (SNP) in genomic region adjacent to shatterproof1 (SHELL) shell thickness gene
attgatgaataaagaaccaaaaaayatactgaactaaaagagagagtatg

SEQ ID NO: 995 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaggtagaaaccccactatggtatrtataacataagaaagaccgttatta

SEQ ID NO: 996 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcttagctagctactttaaggatayaacttttacacattcactcacaaat

SEQ ID NO: 997 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttacacattcactcacaaatcctaragatttagcaaaagagaaaagagag

SEQ ID NO: 998 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaaaggcaagggaagaatagttccyataatagaattttcactagttaata

SEQ ID NO: 999 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttgtaggtaatatataggaactcwattcttaaacttttcaatgtgggat

SEQ ID NO: 1000 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttgtaggtaatatataggaactcawttcttaaacttttcaatgtgggatt

SEQ ID NO: 1001 - DNA, 50 bp, Artificial Sequence
  synthetic Elaeis guineensis (oil palm) single nucleotide polymorphism (SNP) in genomic region adjacent to shatterproof1 (SHELL) shell thickness gene
aacttttcaaaatttattaatatcmaactctcctaacttagacaaaaaat

SEQ ID NO: 1002 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccattttatctagattgtaagatgmataacttgaatgataagattttaac

SEQ ID NO: 1003 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcataaaaggtggtaatcaagtcayattatatttatcaaagcactgtcta

SEQ ID NO: 1004 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttttaaaatttagtgagatggttgyattgcctccatctatgacttaaatt

SEQ ID NO: 1005 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttagtgagatggttgcattgcctycatctatgacttaaatttttggata

SEQ ID NO: 1006 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttgcattgcctccatctatgacttwaatttttggataacaaagccatatc

SEQ ID NO: 1007 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggttagaaaatgttactaaaggtgrtttcatatgattcttaatgtctaaa

SEQ ID NO: 1008 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttcttaatgtctaaaatagtgtttractttcttttctctatttttagtaa

SEQ ID NO: 1009 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctatttttagtaaccaatgtcaacraccttaatgaagcacttgaaaagat

SEQ ID NO: 1010 - DNA, 50 bp, Artificial Sequence
  synthetic Elaeis guineensis (oil palm) single nucleotide polymorphism (SNP) in genomic region adjacent to shatterproof1 (SHELL) shell thickness gene
tattgataactaattgttacttcartaactcatcaaactatttttaataa

SEQ ID NO: 1011 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatgcaacatgatatatcaatatgyttttctattagacaattcaacttct

SEQ ID NO: 1012 - DNA, 50 bp, Artificial Sequence
  synthetic Elaeis guineensis (oil palm) single nucleotide polymorphism (SNP) in genomic region adjacent to shatterproof1 (SHELL) shell thickness gene
agagattaattctcaagtaagaaaracatggcaatttaatctaaaataga

SEQ ID NO: 1013 - DNA, 50 bp, Artificial Sequence
  synthetic Elaeis guineensis (oil palm) single nucleotide polymorphism (SNP) in genomic region adjacent to shatterproof1 (SHELL) shell thickness gene
taattctcaagtaagaaagacatgrcaatttaatctaaaatagatttctc

SEQ ID NO: 1014 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccatatatttttgcctcatatgctyatcagttaaaattcttcatgctcat

SEQ ID NO: 1015 - DNA, 50 bp, Artificial Sequence
  synthetic Elaeis guineensis (oil palm) single nucleotide polymorphism (SNP) in genomic region adjacent to shatterproof1 (SHELL) shell thickness gene
atctttttgttgtttgttcatagcyttacatgtatctttgaatattttgt

SEQ ID NO: 1016 - DNA, 50 bp, Artificial Sequence
  synthetic Elaeis guineensis (oil palm) single nucleotide polymorphism (SNP) in genomic region adjacent to shatterproof1 (SHELL) shell thickness gene
tggtttacaacctttctttgagagytgtaagggtgtaaagggctagatct

SEQ ID NO: 1017 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtcattccttataatgtaagaggtratgaaaagatttttcttgcaaatta

SEQ ID NO: 1018 - DNA, 50 bp, Artificial Sequence
  synthetic Elaeis guineensis (oil palm) single nucleotide polymorphism (SNP) in genomic region adjacent to shatterproof1 (SHELL) shell thickness gene
cattccttataatgtaagaggtaaygaaaagatttttcttgcaaattaga

SEQ ID NO: 1019 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccataattgcttttcctctattttyttttttttcatttcaatcatatttg

SEQ ID NO: 1020 - DNA, 50 bp, Artificial Sequence
  synthetic Elaeis guineensis (oil palm) single nucleotide polymorphism (SNP) in genomic region adjacent to shatterproof1 (SHELL) shell thickness gene
atatttgttatggtgtaggagggarggtatcattaatcccatattagttg

SEQ ID NO: 1021 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctatgagccaaaacggacaatacgwaatagccgagccatgagctcttggt

SEQ ID NO: 1022 - DNA, 50 bp, Artificial Sequence
  synthetic Elaeis guineensis (oil palm) single nucleotide polymorphism (SNP) in genomic region adjacent to shatterproof1 (SHELL) shell thickness gene
atacgtaatagccgagccatgagcycttggttgcaacagtggcacactag

SEQ ID NO: 1023 - DNA, 50 bp, Artificial Sequence
  synthetic Elaeis guineensis (oil palm) single nucleotide polymorphism (SNP) in genomic region adjacent to shatterproof1 (SHELL) shell thickness gene
cgagccatgagctcttggttgcaayagtggcacactaggaaaggaatcac

SEQ ID NO: 1024 - DNA, 50 bp, Artificial Sequence
  synthetic Elaeis guineensis (oil palm) single nucleotide polymorphism (SNP) in genomic region adjacent to shatterproof1 (SHELL) shell thickness gene
acacaaactccttgactggagggcrgtaataaaataaagatgatggtacc

SEQ ID NO: 1025 - DNA, 50 bp, Artificial Sequence
  synthetic Elaeis guineensis (oil palm) single nucleotide polymorphism (SNP) in genomic region adjacent to shatterproof1 (SHELL) shell thickness gene
tggagggcggtaataaaataaagakgatggtaccttccgtctatccatag

SEQ ID NO: 1026 - DNA, 50 bp, Artificial Sequence
  synthetic Elaeis guineensis (oil palm) single nucleotide polymorphism (SNP) in genomic region adjacent to shatterproof1 (SHELL) shell thickness gene
caaaaacggacaatacttcacatgycaagccatgagctcttaatcataat

SEQ ID NO: 1027 - DNA, 50 bp, Artificial Sequence
  synthetic Elaeis guineensis (oil palm) single nucleotide polymorphism (SNP) in genomic region adjacent to shatterproof1 (SHELL) shell thickness gene
agccatgagctcttaatcataatartggagggagggcatcattagtctca

SEQ ID NO: 1028 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggagggagggcatcattagtctcayattggttgtaaatcaaagaagatcc

SEQ ID NO: 1029 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcatagtggctaaagatcgaaacgrataatacatcacatatgcgggagtg

SEQ ID NO: 1030 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcatgatttgtagtgagcattcatstactattttttttccagaactcatt

SEQ ID NO: 1031 - DNA, 50 bp, Artificial Sequence
  synthetic Elaeis guineensis (oil palm) single nucleotide polymorphism (SNP) in genomic region adjacent to shatterproof1 (SHELL) shell thickness gene
atttatctcaattttcatgttttaraagaaggatagatcttgcccaataa

SEQ ID NO: 1032 - DNA, 50 bp, Artificial Sequence
  synthetic Elaeis guineensis (oil palm) single nucleotide polymorphism (SNP) in genomic region adjacent to shatterproof1 (SHELL) shell thickness gene
atttatgaaagtcctatgaaagccytattgtagtcagaaaacaaggtcaa

SEQ ID NO: 1033 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtctatggttgagaacttcaaccamttgactacgttgcctgaatgttcaa

SEQ ID NO: 1034 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttatgatagcaactcttcaaaaaaycaaaaattgtgatgacaactgttgc

SEQ ID NO: 1035 - DNA, 50 bp, Artificial Sequence
  synthetic Elaeis guineensis (oil palm) single nucleotide polymorphism (SNP) in genomic region adjacent to shatterproof1 (SHELL) shell thickness gene
caactcttcaaaaaaccaaaaattrtgatgacaactgttgcctaggcgac

SEQ ID NO: 1036 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaattgtgatgacaactgttgcctrggcgacatgtaagtggttaagattg

SEQ ID NO: 1037 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctaaagtagatgttgaatcataggygaacaatactactgaacaatacata

SEQ ID NO: 1038 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaacaatactactgaacaatacatrtttcttgcatacattggcttgacta

SEQ ID NO: 1039 - DNA, 50 bp, Artificial Sequence
  synthetic Elaeis guineensis (oil palm) single nucleotide polymorphism (SNP) in genomic region adjacent to shatterproof1 (SHELL) shell thickness gene
atacattggcttgactattagtgcyatgcactctaggttcatttatactt

SEQ ID NO: 1040 - DNA, 50 bp, Artificial Sequence
  synthetic Elaeis guineensis (oil palm) single nucleotide polymorphism (SNP) in genomic region adjacent to shatterproof1 (SHELL) shell thickness gene
attagtgctatgcactctaggttcrtttatacttcacaagagtttttatt

SEQ ID NO: 1041 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgaataagagttaagtaaaaggacstaattatcataagctatggaagaca

SEQ ID NO: 1042 - DNA, 50 bp, Artificial Sequence
  synthetic Elaeis guineensis (oil palm) single nucleotide polymorphism (SNP) in genomic region adjacent to shatterproof1 (SHELL) shell thickness gene
atggaagacaagacaagggatactrccattgatactcttagtaaaatagt

SEQ ID NO: 1043 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctgccattgatactcttagtaaaayagtgttataagtgatagtaatagca

SEQ ID NO: 1044 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaaatgcatacaagttgcggtatcmtttgtgaaagagaaagtattttctt

SEQ ID NO: 1045 - DNA, 50 bp, Artificial Sequence
  synthetic Elaeis guineensis (oil palm) single nucleotide polymorphism (SNP) in genomic region adjacent to shatterproof1 (SHELL) shell thickness gene
catttgtgaaagagaaagtattttyttttatttacgtttagtcaaaacca

SEQ ID NO: 1046 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaaagagaaagtattttcttttatytacgtttagtcaaaaccatatttat

SEQ ID NO: 1047 - DNA, 50 bp, Artificial Sequence
  synthetic Elaeis guineensis (oil palm) single nucleotide polymorphism (SNP) in genomic region adjacent to shatterproof1 (SHELL) shell thickness gene
atttgccattataccgccattggtwagaacaaaatgccctcaataccaaa

SEQ ID NO: 1048 - DNA, 50 bp, Artificial Sequence
  synthetic Elaeis guineensis (oil palm) single nucleotide polymorphism (SNP) in genomic region adjacent to shatterproof1 (SHELL) shell thickness gene
cattataccgccattggtaagaacraaatgccctcaataccaaaataaac

SEQ ID NO: 1049 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaatgccctcaataccaaaataaaytgcatttgcaagttatttgaaagaa

SEQ ID NO: 1050 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttgaaagaagtgcaactctattatygtggcatgttaacgagcttttctat

SEQ ID NO: 1051 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctatgatggttatcaaattgtatarcgaaggcaaaaaactatggctaaat

SEQ ID NO: 1052 - DNA, 50 bp, Artificial Sequence
  synthetic Elaeis guineensis (oil palm) single nucleotide polymorphism (SNP) in genomic region adjacent to shatterproof1 (SHELL) shell thickness gene
caaggctctaaagaatatacaaagycttaacttctttacatcctcaaaat

SEQ ID NO: 1053 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctcaagtatctgattggtgttgatratgctccatctaattaattccttca

SEQ ID NO: 1054 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccaaaaatacatatatcctatgacycttaaaaagaaaaggaaaagaggag

SEQ ID NO: 1055 - DNA, 50 bp, Artificial Sequence
  synthetic Elaeis guineensis (oil palm) single nucleotide polymorphism (SNP) in genomic region adjacent to shatterproof1 (SHELL) shell thickness gene
gatgtaagctttacaatccaataaraattttcacacaccaacactaatat

SEQ ID NO: 1056 - DNA, 50 bp, Artificial Sequence
  synthetic Elaeis guineensis (oil palm) single nucleotide polymorphism (SNP) in genomic region adjacent to shatterproof1 (SHELL) shell thickness gene
gctttacaatccaataagaattttyacacaccaacactaatataataata

SEQ ID NO: 1057 - DNA, 50 bp, Artificial Sequence
  synthetic Elaeis guineensis (oil palm) single nucleotide polymorphism (SNP) in genomic region adjacent to shatterproof1 (SHELL) shell thickness gene
taataataataaataaaaaataagyaatagttgttactcttataagtctt

SEQ ID NO: 1058 - DNA, 50 bp, Artificial Sequence
  synthetic Elaeis guineensis (oil palm) single nucleotide polymorphism (SNP) in genomic region adjacent to shatterproof1 (SHELL) shell thickness gene
ataataaaacatgcaaagaaagtayatctttttatataataaatcatatt

SEQ ID NO: 1059 - DNA, 50 bp, Artificial Sequence
  synthetic Elaeis guineensis (oil palm) single nucleotide polymorphism (SNP) in genomic region adjacent to shatterproof1 (SHELL) shell thickness gene
cactgaactatcacaatcatgtttmtggctcatggcaagatatcgacata

SEQ ID NO: 1060 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctggctcatggcaagatatcgacayagtggctagtctcctaaactatcac

SEQ ID NO: 1061 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctaaactatcataatcacattttyagattacggtaaggatcaatatagt

SEQ ID NO: 1062 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaactatcataatcacattttcagwttacggtaaggatcaatatagtggc

SEQ ID NO: 1063 - DNA, 50 bp, Artificial Sequence
  synthetic Elaeis guineensis (oil palm) single nucleotide polymorphism (SNP) in genomic region adjacent to shatterproof1 (SHELL) shell thickness gene
cggtaaggatcaatatagtggcttwtcacacagactaccacaactatatt

SEQ ID NO: 1064 - DNA, 50 bp, Artificial Sequence
  synthetic Elaeis guineensis (oil palm) single nucleotide polymorphism (SNP) in genomic region adjacent to shatterproof1 (SHELL) shell thickness gene
acacagactaccacaactatatttycagcttgtggtggggcatcaacaat

SEQ ID NO: 1065 - DNA, 50 bp, Artificial Sequence
  synthetic Elaeis guineensis (oil palm) single nucleotide polymorphism (SNP) in genomic region adjacent to shatterproof1 (SHELL) shell thickness gene
cagcttgtggtggggcatcaacaayattaatagcctaaagcaccacaacc

SEQ ID NO: 1066 - DNA, 50 bp, Artificial Sequence
  synthetic Elaeis guineensis (oil palm) single nucleotide polymorphism (SNP) in genomic region adjacent to shatterproof1 (SHELL) shell thickness gene
catcaacaatattaatagcctaaarcaccacaacccactattcagttaca

SEQ ID NO: 1067 - DNA, 50 bp, Artificial Sequence
  synthetic Elaeis guineensis (oil palm) single nucleotide polymorphism (SNP) in genomic region adjacent to shatterproof1 (SHELL) shell thickness gene
ataacttcatacagatctctctctmtatatatgtatgtatatatgtatgt

SEQ ID NO: 1068 - DNA, 50 bp, Artificial Sequence
  synthetic Elaeis guineensis (oil palm) single nucleotide polymorphism (SNP) in genomic region adjacent to shatterproof1 (SHELL) shell thickness gene
atgtatgtatatatgtatgtgtgtktgtatacatacaattaacaaataag

SEQ ID NO: 1069 - DNA, 50 bp, Artificial Sequence
  synthetic Elaeis guineensis (oil palm) single nucleotide polymorphism (SNP) in genomic region adjacent to shatterproof1 (SHELL) shell thickness gene
atacatacaattaacaaataagcayatagcatgcaactatcaaaaatcat

SEQ ID NO: 1070 - DNA, 50 bp, Artificial Sequence
  synthetic Elaeis guineensis (oil palm) single nucleotide polymorphism (SNP) in genomic region adjacent to shatterproof1 (SHELL) shell thickness gene
catataaatcaaaatcactatgcayaaaataattgttatataaatagatg

SEQ ID NO: 1071 - DNA, 50 bp, Artificial Sequence
  synthetic Elaeis guineensis (oil palm) single nucleotide polymorphism (SNP) in genomic region adjacent to shatterproof1 (SHELL) shell thickness gene
atataaatagatgatcaatgtctasaaatttttcgctctacgtactgatg

SEQ ID NO: 1072 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctagaaatttttcgctctacgtacygatgacaaacttggttataactatt

SEQ ID NO: 1073 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtccatgcctagcatgtccaatcartcaatataatttcagttcatcctga

SEQ ID NO: 1074 - DNA, 50 bp, Artificial Sequence
  synthetic Elaeis guineensis (oil palm) single nucleotide polymorphism (SNP) in genomic region adjacent to shatterproof1 (SHELL) shell thickness gene
caatcaatcaatataatttcagttyatcctgaatcaaccattagcataaa

SEQ ID NO: 1075 - DNA, 50 bp, Artificial Sequence
  synthetic Elaeis guineensis (oil palm) single nucleotide polymorphism (SNP) in genomic region adjacent to shatterproof1 (SHELL) shell thickness gene
cataaaaattaaataacttattgcyagtgttttaatttcaaagctctaat

SEQ ID NO: 1076 - DNA, 50 bp, Artificial Sequence
  synthetic Elaeis guineensis (oil palm) single nucleotide polymorphism (SNP) in genomic region adjacent to shatterproof1 (SHELL) shell thickness gene
aacttattgccagtgttttaatttyaaagctctaatattcgaattaatct

SEQ ID NO: 1077 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctatactttctaattaaaaattayataattaaataaaaaatttggattt

SEQ ID NO: 1078 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttacataattaaataaaaaatttgrattttatcttgactataaactagag

SEQ ID NO: 1079 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcataaaatcccttgctcagtattycttaattggatgattggtcccatcc

SEQ ID NO: 1080 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcttaattggatgattggtcccatmcaaaatcaaaatcaataattagaaa

SEQ ID NO: 1081 - DNA, 50 bp, Artificial Sequence
  synthetic Elaeis guineensis (oil palm) single nucleotide polymorphism (SNP) in genomic region adjacent to shatterproof1 (SHELL) shell thickness gene
cataaaatggttatcatcgatggtrgaaaatttagaagaagaatatagct

SEQ ID NO: 1082 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggcaatgctagtagcatccagtgaytagtgttagcccaatatacataatc

SEQ ID NO: 1083 - DNA, 50 bp, Artificial Sequence
  synthetic Elaeis guineensis (oil palm) single nucleotide polymorphism (SNP) in genomic region adjacent to shatterproof1 (SHELL) shell thickness gene
taggaatttggtgatgataaaatcmaacaatgcttagcagggtcgggttt

SEQ ID NO: 1084 - DNA, 50 bp, Artificial Sequence
  synthetic Elaeis guineensis (oil palm) single nucleotide polymorphism (SNP) in genomic region adjacent to shatterproof1 (SHELL) shell thickness gene
agggtcgggtttggagttaactatyatacagaacaagtccaaaaccttct

SEQ ID NO: 1085 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaccttcttctaggatcaacatarggtctactatcaagtcttcaaaatc

SEQ ID NO: 1086 - DNA, 50 bp, Artificial Sequence
  synthetic Elaeis guineensis (oil palm) single nucleotide polymorphism (SNP) in genomic region adjacent to shatterproof1 (SHELL) shell thickness gene
tataagaagagagagaaaaagatakaggaagaaagctggtagaaagagat

SEQ ID NO: 1087 - DNA, 50 bp, Artificial Sequence
  synthetic Elaeis guineensis (oil palm) single nucleotide polymorphism (SNP) in genomic region adjacent to shatterproof1 (SHELL) shell thickness gene
gagaagggagaaaaaaagaacaaaycaaatctctctctttctctcttcat

SEQ ID NO: 1088 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttcttcaaaaaggggattttcccytttctccctctctttctcctagcgg

SEQ ID NO: 1089 - DNA, 50 bp, Artificial Sequence
  synthetic Elaeis guineensis (oil palm) single nucleotide polymorphism (SNP) in genomic region adjacent to shatterproof1 (SHELL) shell thickness gene
gattttcccctttctccctctcttyctcctagcggatggctaaggccagc

SEQ ID NO: 1090 - DNA, 50 bp, Artificial Sequence
  synthetic Elaeis guineensis (oil palm) single nucleotide polymorphism (SNP) in genomic region adjacent to shatterproof1 (SHELL) shell thickness gene
cctagcggatggctaaggccagcartctatggtggtgtctagtggtgaag

SEQ ID NO: 1091 - DNA, 50 bp, Artificial Sequence
  synthetic Elaeis guineensis (oil palm) single nucleotide polymorphism (SNP) in genomic region adjacent to shatterproof1 (SHELL) shell thickness gene
tggtggtgtctagtggtgaagatgygatggccgcagtgctacagcgatgg

SEQ ID NO: 1092 - DNA, 50 bp, Artificial Sequence
  synthetic Elaeis guineensis (oil palm) single nucleotide polymorphism (SNP) in genomic region adjacent to shatterproof1 (SHELL) shell thickness gene
cggttggtagtggtagtgggcgatscaatagaaagaaaaggaaatcaaaa

SEQ ID NO: 1093 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttgatatgataagaagactacaagrtggtcagcggtaatgacaagcatcc

SEQ ID NO: 1094 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtggtcagcggtaatgacaagcatycgcattagcttaacctcttatgata

SEQ ID NO: 1095 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcattagcttaacctcttatgatarttgcaaaggcaataatagccacagt

SEQ ID NO: 1096 - DNA, 50 bp, Artificial Sequence
  synthetic Elaeis guineensis (oil palm) single nucleotide polymorphism (SNP) in genomic region adjacent to shatterproof1 (SHELL) shell thickness gene
agaaggtccttagtgcggcaacatycgacggtcttccaagaagatttcag

SEQ ID NO: 1097 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtccttagtgcggcaacatccgacrgtcttccaagaagatttcagccaat

SEQ ID NO: 1098 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcttccaagaagatttcagccaatratggctgtatgaaaataaaaaagaa

SEQ ID NO: 1099 - DNA, 50 bp, Artificial Sequence
  synthetic Elaeis guineensis (oil palm) single nucleotide polymorphism (SNP) in genomic region adjacent to shatterproof1 (SHELL) shell thickness gene
ataaaaaagaaaaaaaggtaccaayaagatgggaggccacgatgcctcga

SEQ ID NO: 1100 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggtaccaataagatgggaggccacratgcctcgatcatctctaatgatgg

SEQ ID NO: 1101 - DNA, 50 bp, Artificial Sequence
  synthetic Elaeis guineensis (oil palm) single nucleotide polymorphism (SNP) in genomic region adjacent to shatterproof1 (SHELL) shell thickness gene
atacagtggaagcttggctttataratgatggaggctagggttttctagc

SEQ ID NO: 1102 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatgatggaggctagggttttctarcctccgatgagttggagaaggagcc

SEQ ID NO: 1103 - DNA, 50 bp, Artificial Sequence
  synthetic Elaeis guineensis (oil palm) single nucleotide polymorphism (SNP) in genomic region adjacent to shatterproof1 (SHELL) shell thickness gene
cctccgatgagttggagaaggagcyagagtcaaactctttcttcgactca

SEQ ID NO: 1104 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttcttcgactcaaataggggaagrgaaggtctttccttccttcccattg

SEQ ID NO: 1105 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttcgactcaaataggggaagggaargtctttccttccttcccattgtttc

SEQ ID NO: 1106 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttcaagcctctacaaccatatgamatcataatgtcaaagctagaaaagg

SEQ ID NO: 1107 - DNA, 50 bp, Artificial Sequence
  synthetic Elaeis guineensis (oil palm) single nucleotide polymorphism (SNP) in genomic region adjacent to shatterproof1 (SHELL) shell thickness gene
acaaccatatgaaatcataatgtcraagctagaaaaggagatctatgcca

SEQ ID NO: 1108 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaggagatctatgccataatattycaattccaagcctaatcaaagaacc

SEQ ID NO: 1109 - DNA, 50 bp, Artificial Sequence
  synthetic Elaeis guineensis (oil palm) single nucleotide polymorphism (SNP) in genomic region adjacent to shatterproof1 (SHELL) shell thickness gene
gatacctaagttctccctagcattrtctatggtaagaaaatctattaatt

SEQ ID NO: 1110 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctagcattatctatggtaagaaaayctattaattaaaattgcataattat

SEQ ID NO: 1111 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagaaaatctattaattaaaattgmataattatatctaaatcagtcaaag

SEQ ID NO: 1112 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctctctttctttatcaaaattatmctcctttaccaggaaactaattcga

SEQ ID NO: 1113 - DNA, 50 bp, Artificial Sequence
  synthetic Elaeis guineensis (oil palm) single nucleotide polymorphism (SNP) in genomic region adjacent to shatterproof1 (SHELL) shell thickness gene
atcttttggatcaaagaattaatgyatttaattagtttcaaaataactca

SEQ ID NO: 1114 - DNA, 50 bp, Artificial Sequence
  synthetic Elaeis guineensis (oil palm) single nucleotide polymorphism (SNP) in genomic region adjacent to shatterproof1 (SHELL) shell thickness gene
taatctaaatccatcgattcctctrggttgactaggtgaattctaacaaa

SEQ ID NO: 1115 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttctaacaaaataccgcttaatatyggaaccaagaagatccaaaatttta

SEQ ID NO: 1116 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttaaattaatcctgacttctctaayagttcaattagactatcaagatcac

SEQ ID NO: 1117 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttaatcctgacttctctaacagttyaattagactatcaagatcacctttt

SEQ ID NO: 1118 - DNA, 50 bp, Artificial Sequence
  synthetic Elaeis guineensis (oil palm) single nucleotide polymorphism (SNP) in genomic region adjacent to shatterproof1 (SHELL) shell thickness gene
acttctctaacagttcaattagacwatcaagatcaccttttctcttggaa

SEQ ID NO: 1119 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttctaacaagttagaaaactctaartcaacattcttattaacttgtttat

SEQ ID NO: 1120 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttcactacaattcttagtatcaatygacaaaccacatgaacgccccttat

SEQ ID NO: 1121 - DNA, 50 bp, Artificial Sequence
  synthetic Elaeis guineensis (oil palm) single nucleotide polymorphism (SNP) in genomic region adjacent to shatterproof1 (SHELL) shell thickness gene
cacatgaacgccccttatatgttaracatatacaagtccaccagaatcaa

SEQ ID NO: 1122 - DNA, 50 bp, Artificial Sequence
  synthetic Elaeis guineensis (oil palm) single nucleotide polymorphism (SNP) in genomic region adjacent to shatterproof1 (SHELL) shell thickness gene
tagacatatacaagtccaccagaaycaatttctctactcaattaaatatc

SEQ ID NO: 1123 - DNA, 50 bp, Artificial Sequence
  synthetic Elaeis guineensis (oil palm) single nucleotide polymorphism (SNP) in genomic region adjacent to shatterproof1 (SHELL) shell thickness gene
atagcaagatactatagacctgctyataagcctaactctgattagaattt

SEQ ID NO: 1124 - DNA, 50 bp, Artificial Sequence
  synthetic Elaeis guineensis (oil palm) single nucleotide polymorphism (SNP) in genomic region adjacent to shatterproof1 (SHELL) shell thickness gene
atagacctgctcataagcctaactytgattagaatttaacacatccaact

SEQ ID NO: 1125 - DNA, 50 bp, Artificial Sequence
  synthetic Elaeis guineensis (oil palm) single nucleotide polymorphism (SNP) in genomic region adjacent to shatterproof1 (SHELL) shell thickness gene
gataatttaaattatcaaagattcyaccaagatgcatatctcatatccaa

SEQ ID NO: 1126 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatttaaattatcaaagattctacyaagatgcatatctcatatccaattg

SEQ ID NO: 1127 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctaccaagatgcatatctcatatycaattgataaaatctaatccattaa

SEQ ID NO: 1128 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgatcttcttataggtttgattctygaagaatgtttatttttaacactat

SEQ ID NO: 1129 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttataggtttgattctcgaagaatrtttatttttaacactatgtaattct

SEQ ID NO: 1130 - DNA, 50 bp, Artificial Sequence
  synthetic Elaeis guineensis (oil palm) single nucleotide polymorphism (SNP) in genomic region adjacent to shatterproof1 (SHELL) shell thickness gene
cctaaacaacttgctagtaaagtcyaaaattttaatgatcaaacaattaa

SEQ ID NO: 1131 - DNA, 50 bp, Artificial Sequence
  synthetic Elaeis guineensis (oil palm) single nucleotide polymorphism (SNP) in genomic region adjacent to shatterproof1 (SHELL) shell thickness gene
atattaagtttagaatttcaaaaayatctaagtgacaattgagcaagtac

SEQ ID NO: 1132 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtgacaattgagcaagtacacacarcataacacaatctaccaatatatca

SEQ ID NO: 1133 - DNA, 50 bp, Artificial Sequence
  synthetic Elaeis guineensis (oil palm) single nucleotide polymorphism (SNP) in genomic region adjacent to shatterproof1 (SHELL) shell thickness gene
atacttaggtcaaatcttacttatygaaattagagacataacttatccat

SEQ ID NO: 1134 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatcttacttattgaaattagagayataacttatccattccttttgtact

SEQ ID NO: 1135 - DNA, 50 bp, Artificial Sequence
  synthetic Elaeis guineensis (oil palm) single nucleotide polymorphism (SNP) in genomic region adjacent to shatterproof1 (SHELL) shell thickness gene
cttttgtactcataatatgccaagycttatgcataaatttttatcataat

SEQ ID NO: 1136 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatttctactatgtacattacatcyctagtgatcacaactttaagttcaa

SEQ ID NO: 1137 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaatatcaattaagttataatcccwaataatcataacctagctctgacac

SEQ ID NO: 1138 - DNA, 50 bp, Artificial Sequence
  synthetic Elaeis guineensis (oil palm) single nucleotide polymorphism (SNP) in genomic region adjacent to shatterproof1 (SHELL) shell thickness gene
atgatggccgtatactttctaggayaagatcctaaagaatatgcaagatt

SEQ ID NO: 1139 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccgtatactttctaggacaagatcytaaagaatatgcaagattttaaatt

SEQ ID NO: 1140 - DNA, 50 bp, Artificial Sequence
  synthetic Elaeis guineensis (oil palm) single nucleotide polymorphism (SNP) in genomic region adjacent to shatterproof1 (SHELL) shell thickness gene
atgaatattacacattaacaaataycaaaccttgtataatttataaaatt

SEQ ID NO: 1141 - DNA, 50 bp, Artificial Sequence
  synthetic Elaeis guineensis (oil palm) single nucleotide polymorphism (SNP) in genomic region adjacent to shatterproof1 (SHELL) shell thickness gene
gatcatctgattggtattgatgatrttccatctaatcaattctttcaacc

SEQ ID NO: 1142 - DNA, 50 bp, Artificial Sequence
  synthetic Elaeis guineensis (oil palm) single nucleotide polymorphism (SNP) in genomic region adjacent to shatterproof1 (SHELL) shell thickness gene
cagatcctataatatttaggtgctrggctctaaattattacaactatatt

SEQ ID NO: 1143 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtggactatcacaatcacatttttrgcatgaggttggacataagcatagt

SEQ ID NO: 1144 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcacatttttagcatgaggttggayataagcatagtggctaatctagagg

SEQ ID NO: 1145 - DNA, 50 bp, Artificial Sequence
  synthetic Elaeis guineensis (oil palm) single nucleotide polymorphism (SNP) in genomic region adjacent to shatterproof1 (SHELL) shell thickness gene
ataagcatagtggctaatctagagrgtcataagtgctcaactctgactac

SEQ ID NO: 1146 - DNA, 50 bp, Artificial Sequence
  synthetic Elaeis guineensis (oil palm) single nucleotide polymorphism (SNP) in genomic region adjacent to shatterproof1 (SHELL) shell thickness gene
attgggatatcaataaaatggctarttcagaaaactacaagtactcaact

SEQ ID NO: 1147 - DNA, 50 bp, Artificial Sequence
  synthetic Elaeis guineensis (oil palm) single nucleotide polymorphism (SNP) in genomic region adjacent to shatterproof1 (SHELL) shell thickness gene
gggatatcaataaaatggctagttyagaaaactacaagtactcaactcta

SEQ ID NO: 1148 - DNA, 50 bp, Artificial Sequence
  synthetic Elaeis guineensis (oil palm) single nucleotide polymorphism (SNP) in genomic region adjacent to shatterproof1 (SHELL) shell thickness gene
caaaatagcaagcctagagcaccayaatccaccattcaaggacacaattc

SEQ ID NO: 1149 - DNA, 50 bp, Artificial Sequence
  synthetic Elaeis guineensis (oil palm) single nucleotide polymorphism (SNP) in genomic region adjacent to shatterproof1 (SHELL) shell thickness gene
aataatttaagatcatatttctttrtaaaatttaatacataaaattacca

SEQ ID NO: 1150 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaccactcaagttgggataagtgayatgtgatatataactttatacagaa

SEQ ID NO: 1151 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatacttaagaaataaatgtatagmatataactatcaaaaactatataga

SEQ ID NO: 1152 - DNA, 50 bp, Artificial Sequence
  synthetic Elaeis guineensis (oil palm) single nucleotide polymorphism (SNP) in genomic region adjacent to shatterproof1 (SHELL) shell thickness gene
atagcatataactatcaaaaactayatagatcaaaatcattaattcacaa

SEQ ID NO: 1153 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcttatctctactaatgacaaactyggttacaactattttcttgtccatg

SEQ ID NO: 1154 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaactcggttacaactattttcttrtccatgcctaatatatccaaccaat

SEQ ID NO: 1155 - DNA, 50 bp, Artificial Sequence
  synthetic Elaeis guineensis (oil palm) single nucleotide polymorphism (SNP) in genomic region adjacent to shatterproof1 (SHELL) shell thickness gene
aactattttcttgtccatgcctaayatatccaaccaatcaacataattcc

SEQ ID NO: 1156 - DNA, 50 bp, Artificial Sequence
  synthetic Elaeis guineensis (oil palm) single nucleotide polymorphism (SNP) in genomic region adjacent to shatterproof1 (SHELL) shell thickness gene
atttaaaattatataattaaataaraaattaagattttatcttgacttgt

SEQ ID NO: 1157 - DNA, 50 bp, Artificial Sequence
  synthetic Elaeis guineensis (oil palm) single nucleotide polymorphism (SNP) in genomic region adjacent to shatterproof1 (SHELL) shell thickness gene
actaaagcataacatttcttgcttygcattttcttattgggatgattgct

SEQ ID NO: 1158 - DNA, 50 bp, Artificial Sequence
  synthetic Elaeis guineensis (oil palm) single nucleotide polymorphism (SNP) in genomic region adjacent to shatterproof1 (SHELL) shell thickness gene
catttcttgctttgcattttcttaytgggatgattgctctcatccaaaat

SEQ ID NO: 1159 - DNA, 50 bp, Artificial Sequence
  synthetic Elaeis guineensis (oil palm) single nucleotide polymorphism (SNP) in genomic region adjacent to shatterproof1 (SHELL) shell thickness gene
atggtggaaaacttagaagaagaayagttggtcgaataataacatccgat

SEQ ID NO: 1160 - DNA, 50 bp, Artificial Sequence
  synthetic Elaeis guineensis (oil palm) single nucleotide polymorphism (SNP) in genomic region adjacent to shatterproof1 (SHELL) shell thickness gene
aacatccgatggcccaagtgggttygatctagatgccttagctagtgatt

SEQ ID NO: 1161 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcgtctatgatgggtttcgtggttrcttgatcaagatcaaggtgaagaag

SEQ ID NO: 1162 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccagtgtcagcccatctaggtgatycaaatgattaatctataattaagag

SEQ ID NO: 1163 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgatccaaatgattaatctataatyaagagccaaattatagctcaataga

SEQ ID NO: 1164 - DNA, 50 bp, Artificial Sequence
  synthetic Elaeis guineensis (oil palm) single nucleotide polymorphism (SNP) in genomic region adjacent to shatterproof1 (SHELL) shell thickness gene
taaaatccaacaatgcccggcaagrgtcgggttaggagtgaacaattata

SEQ ID NO: 1165 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatccaacaatgcccggcaagagtygggttaggagtgaacaattatagag

SEQ ID NO: 1166 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccatcaagtcttctaaatctatctwtctttcttttttttttatgcctaaa

SEQ ID NO: 1167 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatccaagaagagagataacaataragggagaatgtagagagagatgtga

SEQ ID NO: 1168 - DNA, 50 bp, Artificial Sequence
  synthetic Elaeis guineensis (oil palm) single nucleotide polymorphism (SNP) in genomic region adjacent to shatterproof1 (SHELL) shell thickness gene
cttctttcttcaaatagaagatttycctttctccctctcgtcctccaaac

SEQ ID NO: 1169 - DNA, 50 bp, Artificial Sequence
  synthetic Elaeis guineensis (oil palm) single nucleotide polymorphism (SNP) in genomic region adjacent to shatterproof1 (SHELL) shell thickness gene
atggcagtggatggctgaggccaayagcctgcgatggcatccaacagtga

SEQ ID NO: 1170 - DNA, 50 bp, Artificial Sequence
  synthetic Elaeis guineensis (oil palm) single nucleotide polymorphism (SNP) in genomic region adjacent to shatterproof1 (SHELL) shell thickness gene
caaccccagtagcaacaatgatggyagctggtggcagcagtgggcaatcg

SEQ ID NO: 1171 - DNA, 50 bp, Artificial Sequence
  synthetic Elaeis guineensis (oil palm) single nucleotide polymorphism (SNP) in genomic region adjacent to shatterproof1 (SHELL) shell thickness gene
caatcggatataaagaagaagaaartcaaagcaaaataaggcaagaggcc

SEQ ID NO: 1172 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaagaagaaaatcaaagcaaaatarggcaagaggccttgctttgatccaa

SEQ ID NO: 1173 - DNA, 50 bp, Artificial Sequence
  synthetic Elaeis guineensis (oil palm) single nucleotide polymorphism (SNP) in genomic region adjacent to shatterproof1 (SHELL) shell thickness gene
atggcaataatggccatggtggccratggtggatgaatcaaagaaaatag

SEQ ID NO: 1174 - DNA, 50 bp, Artificial Sequence
  synthetic Elaeis guineensis (oil palm) single nucleotide polymorphism (SNP) in genomic region adjacent to shatterproof1 (SHELL) shell thickness gene
atggtggccaatggtggatgaatcraagaaaataggggatccttggtgcg

SEQ ID NO: 1175 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggtggatgaatcaaagaaaataggrgatccttggtgcggcaagatctaat

SEQ ID NO: 1176 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcaaagaaaataggggatccttggygcggcaagatctaatggtctttcaa

SEQ ID NO: 1177 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttcaagaagatcttagccaacaatrgctacacgaggataggaaggaagga

SEQ ID NO: 1178 - DNA, 50 bp, Artificial Sequence
  synthetic Elaeis guineensis (oil palm) single nucleotide polymorphism (SNP) in genomic region adjacent to shatterproof1 (SHELL) shell thickness gene
taggaaggaaggagagaaagtgccmatgagatgggaggcgatgcctcatc

SEQ ID NO: 1179 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcatctcctatgatggttcaaccaygattgggctaaaacttttttctcct

SEQ ID NO: 1180 - DNA, 50 bp, Artificial Sequence
  synthetic Elaeis guineensis (oil palm) single nucleotide polymorphism (SNP) in genomic region adjacent to shatterproof1 (SHELL) shell thickness gene
acttttttctcctccttttttgacratgcaatcaattgatttctcaatag

SEQ ID NO: 1181 - DNA, 50 bp, Artificial Sequence
  synthetic Elaeis guineensis (oil palm) single nucleotide polymorphism (SNP) in genomic region adjacent to shatterproof1 (SHELL) shell thickness gene
gacaatggaggctaaggtttcctarcatccaatgagtttgagaagaagca

SEQ ID NO: 1182 - DNA, 50 bp, Artificial Sequence
  synthetic Elaeis guineensis (oil palm) single nucleotide polymorphism (SNP) in genomic region adjacent to shatterproof1 (SHELL) shell thickness gene
actccttcgactcaaacaaaggaarggaaggtctttccttccttcctatt

SEQ ID NO: 1183 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgggtagggtatcacaacagttttrtttctaaattgtcattatcaggaag

SEQ ID NO: 1184 - DNA, 50 bp, Artificial Sequence
  synthetic Elaeis guineensis (oil palm) single nucleotide polymorphism (SNP) in genomic region adjacent to shatterproof1 (SHELL) shell thickness gene
tacaccacattcgatgtagaaaaaytgcaccactccgcctaattgagcca

SEQ ID NO: 1185 - DNA, 50 bp, Artificial Sequence
  synthetic Elaeis guineensis (oil palm) single nucleotide polymorphism (SNP) in genomic region adjacent to shatterproof1 (SHELL) shell thickness gene
accacattcgatgtagaaaaactgyaccactccgcctaattgagccacat

SEQ ID NO: 1186 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatcttatggccatattataatatyctgcaatcaaattatgatttcttat

SEQ ID NO: 1187 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttatggccatattataatatcctgyaatcaaattatgatttcttatatac

SEQ ID NO: 1188 - DNA, 50 bp, Artificial Sequence
  synthetic Elaeis guineensis (oil palm) single nucleotide polymorphism (SNP) in genomic region adjacent to shatterproof1 (SHELL) shell thickness gene
cattggaaaacggtgcattacatgrctcaatcagatggcgcggtgcattt

SEQ ID NO: 1189 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcggtgtacaaagaatttctcttaytaggaaatatcttgagtctagaccg

SEQ ID NO: 1190 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctaggaaatatcttgagtctagachggcccatttgtcatttagaccaatc

SEQ ID NO: 1191 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcaaggactatgaattttggtccayaataagtatgagatcgtcatgggat

SEQ ID NO: 1192 - DNA, 50 bp, Artificial Sequence
  synthetic Elaeis guineensis (oil palm) single nucleotide polymorphism (SNP) in genomic region adjacent to shatterproof1 (SHELL) shell thickness gene
cataataagtatgagatcgtcatgrgattgaaaaagatgggaaataactc

SEQ ID NO: 1193 - DNA, 50 bp, Artificial Sequence
  synthetic Elaeis guineensis (oil palm) single nucleotide polymorphism (SNP) in genomic region adjacent to shatterproof1 (SHELL) shell thickness gene
gatcgtcatgggattgaaaaagatrggaaataactcctcagtttgcccct

SEQ ID NO: 1194 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaagatgggaaataactcctcagtktgccccttgacagctcacaattctt

SEQ ID NO: 1195 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccaatgctatccatataaaaggtayttgttttctattaatgtcattgcac

SEQ ID NO: 1196 - DNA, 50 bp, Artificial Sequence
  synthetic Elaeis guineensis (oil palm) single nucleotide polymorphism (SNP) in genomic region adjacent to shatterproof1 (SHELL) shell thickness gene
actaatgaagacagcttcagcaaakatagagcagaaatcctttaaatttt

SEQ ID NO: 1197 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagggaaatcattgtggttcacagrtgggggtagagcatgtaagatacga

SEQ ID NO: 1198 - DNA, 50 bp, Artificial Sequence
  synthetic Elaeis guineensis (oil palm) single nucleotide polymorphism (SNP) in genomic region adjacent to shatterproof1 (SHELL) shell thickness gene
atttgtattctgttctgcccccagmaatcagcataggcaccatgatgcat

SEQ ID NO: 1199 - DNA, 50 bp, Artificial Sequence
  synthetic Elaeis guineensis (oil palm) single nucleotide polymorphism (SNP) in genomic region adjacent to shatterproof1 (SHELL) shell thickness gene
aacttcagaattttttggcccatcyagctctttaatttgatttttgatgc

SEQ ID NO: 1200 - DNA, 50 bp, Artificial Sequence
  synthetic Elaeis guineensis (oil palm) single nucleotide polymorphism (SNP) in genomic region adjacent to shatterproof1 (SHELL) shell thickness gene
gagaacaaaactctcttccttgtcyttgtctgctatttctttctgatata

SEQ ID NO: 1201 - DNA, 50 bp, Artificial Sequence
  synthetic Elaeis guineensis (oil palm) single nucleotide polymorphism (SNP) in genomic region adjacent to shatterproof1 (SHELL) shell thickness gene
acatctcaacaaccataactgaagscccttcaaagctaaaatgcctgtta

SEQ ID NO: 1202 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccataactgaagccccttcaaagcyaaaatgcctgttaatttgttcttca

SEQ ID NO: 1203 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatggcattttttcctagatgtccmtaccgatactaacggtattttggag

SEQ ID NO: 1204 - DNA, 50 bp, Artificial Sequence
  synthetic Elaeis guineensis (oil palm) single nucleotide polymorphism (SNP) in genomic region adjacent to shatterproof1 (SHELL) shell thickness gene
agtctctaaaattttcacttgttgwttccattgattctatttctttatat

SEQ ID NO: 1205 - DNA, 50 bp, Artificial Sequence
  synthetic Elaeis guineensis (oil palm) single nucleotide polymorphism (SNP) in genomic region adjacent to shatterproof1 (SHELL) shell thickness gene
acaacactattcacaccatcaagaycagacaacccttcatcttggatatg

SEQ ID NO: 1206 - DNA, 50 bp, Artificial Sequence
  synthetic Elaeis guineensis (oil palm) single nucleotide polymorphism (SNP) in genomic region adjacent to shatterproof1 (SHELL) shell thickness gene
caaatgaaaaacctaaaatgctgaraggaatctccacaattatggaggaa

SEQ ID NO: 1207 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaggaattagtacttcttagaccaygaagctaaaactagatctgcaatcc

SEQ ID NO: 1208 - DNA, 50 bp, Artificial Sequence
  synthetic Elaeis guineensis (oil palm) single nucleotide polymorphism (SNP) in genomic region adjacent to shatterproof1 (SHELL) shell thickness gene
gccgagtgtcaccaaaacattattsaagttgctaagccaagccctcaaag

SEQ ID NO: 1209 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttttgcgtgatgcatataggcctkgtagatcaccaaaaccagactcgcc

SEQ ID NO: 1210 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtaagtccaggttttccagtagtcytgtgattcttgcctccagctaatgc

SEQ ID NO: 1211 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccagctaatgctttagcagaccatwgcaagcaaatctctgtcagcaacta

SEQ ID NO: 1212 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcagaccattgcaagcaaatctctrtcagcaactatatggtcacttggag

SEQ ID NO: 1213 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgcttgtctttttgcttatagcctycaatttatttgatattatagtatta

SEQ ID NO: 1214 - DNA, 50 bp, Artificial Sequence
  synthetic Elaeis guineensis (oil palm) single nucleotide polymorphism (SNP) in genomic region adjacent to shatterproof1 (SHELL) shell thickness gene
gccttcaatttatttgatattatartattaacccaagctcaagctcgact

SEQ ID NO: 1215 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttatttgatattatagtattaaccyaagctcaagctcgactcgatgaaaa

SEQ ID NO: 1216 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagctcgactcgatgaaaaatagayaaaactcgagttgagcttgaatatc

SEQ ID NO: 1217 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcgagttcgagatcaagtcttagcktactaataagatatatatatatata

SEQ ID NO: 1218 - DNA, 50 bp, Artificial Sequence
  synthetic Elaeis guineensis (oil palm) single nucleotide polymorphism (SNP) in genomic region adjacent to shatterproof1 (SHELL) shell thickness gene
aactttgactcatttgtatacatcrtaagcttctaaagatagccataaga

SEQ ID NO: 1219 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaggagggtggtaccaacctatcgrctgaagtttcgttggtgaatgttaa

SEQ ID NO: 1220 - DNA, 50 bp, Artificial Sequence
  synthetic Elaeis guineensis (oil palm) single nucleotide polymorphism (SNP) in genomic region adjacent to shatterproof1 (SHELL) shell thickness gene
taccaacctatcggctgaagtttcrttggtgaatgttaatttttgcaaat

SEQ ID NO: 1221 - DNA, 50 bp, Artificial Sequence
  synthetic Elaeis guineensis (oil palm) single nucleotide polymorphism (SNP) in genomic region adjacent to shatterproof1 (SHELL) shell thickness gene
atacaagccaatgatctgtatttamttagctcccagttgctagatggaat

SEQ ID NO: 1222 - DNA, 50 bp, Artificial Sequence
  synthetic Elaeis guineensis (oil palm) single nucleotide polymorphism (SNP) in genomic region adjacent to shatterproof1 (SHELL) shell thickness gene
tggattgaaggtactaaagcatttraaaataaaaaatttctcacaatccg

SEQ ID NO: 1223 - DNA, 50 bp, Artificial Sequence
  synthetic Elaeis guineensis (oil palm) single nucleotide polymorphism (SNP) in genomic region adjacent to shatterproof1 (SHELL) shell thickness gene
attaatcagcaatcactaggtcgcwggtttgaattcggcaagttagattt

SEQ ID NO: 1224 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttatcctttaaaatttttacatcayaaactttaaattataatttacaaat

SEQ ID NO: 1225 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttacaaatatttatttcatttacwacaacagaacatatagcatgagaag

SEQ ID NO: 1226 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttatttctcaaaaatgtttttgtgkcaacacatctaacaatatcattgtc

SEQ ID NO: 1227 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctcaaaaatgtttttgtgtcaacayatctaacaatatcattgtcaaactt

SEQ ID NO: 1228 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttgtgtcaacacatctaacaatakcattgtcaaacttttatataaagca

SEQ ID NO: 1229 - DNA, 50 bp, Artificial Sequence
  synthetic Elaeis guineensis (oil palm) single nucleotide polymorphism (SNP) in genomic region adjacent to shatterproof1 (SHELL) shell thickness gene
attattcaatacttttaatcttgcmtttgctatgccgcttttagtttctt

SEQ ID NO: 1230 - DNA, 50 bp, Artificial Sequence
  synthetic Elaeis guineensis (oil palm) single nucleotide polymorphism (SNP) in genomic region adjacent to shatterproof1 (SHELL) shell thickness gene
cttaacccctttttatagatgcttytgatgtaaccgtcgagcacatagtc

SEQ ID NO: 1231 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgtaaccgtcgagcacatagtcccrctttttatgacgctaaattatcggg

SEQ ID NO: 1232 - DNA, 50 bp, Artificial Sequence
  synthetic Elaeis guineensis (oil palm) single nucleotide polymorphism (SNP) in genomic region adjacent to shatterproof1 (SHELL) shell thickness gene
cgggccataaatataaaattaatgrggcgttaattctccttaatagccgt

SEQ ID NO: 1233 - DNA, 50 bp, Artificial Sequence
  synthetic Elaeis guineensis (oil palm) single nucleotide polymorphism (SNP) in genomic region adjacent to shatterproof1 (SHELL) shell thickness gene
gctcagtcggtcgatgaagagtcaraactgcatgttcaaccgatatgcag

SEQ ID NO: 1234 - DNA, 50 bp, Artificial Sequence
  synthetic Elaeis guineensis (oil palm) single nucleotide polymorphism (SNP) in genomic region adjacent to shatterproof1 (SHELL) shell thickness gene
taccccaacagttacccccactctyaaagtccaaggtgaaccgacgtgta

SEQ ID NO: 1235 - DNA, 50 bp, Artificial Sequence
  synthetic Elaeis guineensis (oil palm) single nucleotide polymorphism (SNP) in genomic region adjacent to shatterproof1 (SHELL) shell thickness gene
cagtgtcagacatcattttggaaartcaattcgacgtcggatgatatgat

SEQ ID NO: 1236 - DNA, 50 bp, Artificial Sequence
  synthetic Elaeis guineensis (oil palm) single nucleotide polymorphism (SNP) in genomic region adjacent to shatterproof1 (SHELL) shell thickness gene
gacaaatagatttgtgccatatgtytgaatgttattgggtcggatctgtt

SEQ ID NO: 1237 - DNA, 50 bp, Artificial Sequence
  synthetic Elaeis guineensis (oil palm) single nucleotide polymorphism (SNP) in genomic region adjacent to shatterproof1 (SHELL) shell thickness gene
agatgttgccacatgtcacatctgrtaaattttcgattcaatcaccttca

SEQ ID NO: 1238 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccaacgtctgaggttgttattttcrtctttttcagatcaagtttctgtct

SEQ ID NO: 1239 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctcttatggctaggacttcttctygggacggtcggttggagaatccgac

SEQ ID NO: 1240 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttgcccctagggctgatggtcggrtgaatatcccttttttgggccaggt

SEQ ID NO: 1241 - DNA, 50 bp, Artificial Sequence
  synthetic Elaeis guineensis (oil palm) single nucleotide polymorphism (SNP) in genomic region adjacent to shatterproof1 (SHELL) shell thickness gene
cctggcacagaaggagcttgtgaaygaacagaccctttatgatgccgacc

SEQ ID NO: 1242 - DNA, 50 bp, Artificial Sequence
  synthetic Elaeis guineensis (oil palm) single nucleotide polymorphism (SNP) in genomic region adjacent to shatterproof1 (SHELL) shell thickness gene
gactttacttttcttttacttgttkagttgtactgacttctattgtaatt

SEQ ID NO: 1243 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctccatctgcatcggttcctgagcygatcccgatactatcagccccgaca

SEQ ID NO: 1244 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctgaacaatctgtggctgcgccarttgctccttcagctggggcgcagtc

SEQ ID NO: 1245 - DNA, 50 bp, Artificial Sequence
  synthetic Elaeis guineensis (oil palm) single nucleotide polymorphism (SNP) in genomic region adjacent to shatterproof1 (SHELL) shell thickness gene
gggactgccggcaagggatcggggraaagctctggtgacttcgacggaag

SEQ ID NO: 1246 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttcacttcgaccttcaagtacctgrtgataaattgaccctggccaatccg

SEQ ID NO: 1247 - DNA, 50 bp, Artificial Sequence
  synthetic Elaeis guineensis (oil palm) single nucleotide polymorphism (SNP) in genomic region adjacent to shatterproof1 (SHELL) shell thickness gene
aataaggtggcagccgtcgatgctragaaagcggccgcactcgaacaact

SEQ ID NO: 1248 - DNA, 50 bp, Artificial Sequence
  synthetic Elaeis guineensis (oil palm) single nucleotide polymorphism (SNP) in genomic region adjacent to shatterproof1 (SHELL) shell thickness gene
gacggatgcatcgaagaacttaaartcgaacgtggatgtcattgggccag

SEQ ID NO: 1249 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttgagtcagacaatcaaggattttyggagttcgaaagaattcaaggaaga

SEQ ID NO: 1250 - DNA, 50 bp, Artificial Sequence
  synthetic Elaeis guineensis (oil palm) single nucleotide polymorphism (SNP) in genomic region adjacent to shatterproof1 (SHELL) shell thickness gene
tacccgaagctcgacttgagcagtrtcgtccctccaagatcggaagatgg

SEQ ID NO: 1251 - DNA, 50 bp, Artificial Sequence
  synthetic Elaeis guineensis (oil palm) single nucleotide polymorphism (SNP) in genomic region adjacent to shatterproof1 (SHELL) shell thickness gene
agcagtatcgtccctccaagatcgraagatggggttgttgaaaaagaagc

SEQ ID NO: 1252 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttgggtaatcaaatacctataatcrgacttcagtccaattttgtaacttt

SEQ ID NO: 1253 - DNA, 50 bp, Artificial Sequence
  synthetic Elaeis guineensis (oil palm) single nucleotide polymorphism (SNP) in genomic region adjacent to shatterproof1 (SHELL) shell thickness gene
agtcagtttttatagtggaaagccracattaaaaatcaaaatataatcgg

SEQ ID NO: 1254 - DNA, 50 bp, Artificial Sequence
  synthetic Elaeis guineensis (oil palm) single nucleotide polymorphism (SNP) in genomic region adjacent to shatterproof1 (SHELL) shell thickness gene
agtgaaagctgaaataaactctatrtcgaagtacagtcgatagtttggct

SEQ ID NO: 1255 - DNA, 50 bp, Artificial Sequence
  synthetic Elaeis guineensis (oil palm) single nucleotide polymorphism (SNP) in genomic region adjacent to shatterproof1 (SHELL) shell thickness gene
attgatagaacttgaccaaggtttytgattataatactgaagattctgta

SEQ ID NO: 1256 - DNA, 50 bp, Artificial Sequence
  synthetic Elaeis guineensis (oil palm) single nucleotide polymorphism (SNP) in genomic region adjacent to shatterproof1 (SHELL) shell thickness gene
aggtgatacatcttcagattgtcgrcatttcatgttcaaaaaattatcga

SEQ ID NO: 1257 - DNA, 50 bp, Artificial Sequence
  synthetic Elaeis guineensis (oil palm) single nucleotide polymorphism (SNP) in genomic region adjacent to shatterproof1 (SHELL) shell thickness gene
agcttgctgtcggagttctgaaagragatttaagtcggctcttcgatatt

SEQ ID NO: 1258 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttgatggcaatccaatctcgagcgrgatcattgcttctgttctataagcc

SEQ ID NO: 1259 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaggatcaaatatgtcgattctccrttgtacgaagggctatggtgctaca

SEQ ID NO: 1260 - DNA, 50 bp, Artificial Sequence
  synthetic Elaeis guineensis (oil palm) single nucleotide polymorphism (SNP) in genomic region adjacent to shatterproof1 (SHELL) shell thickness gene
caatcgatgtcaactgactagccgrttgatgttgtatatttacatacctt

SEQ ID NO: 1261 - DNA, 50 bp, Artificial Sequence
  synthetic Elaeis guineensis (oil palm) single nucleotide polymorphism (SNP) in genomic region adjacent to shatterproof1 (SHELL) shell thickness gene
gatttatctcccaaataattttcayaaatctcttcatgtacttctctaag

SEQ ID NO: 1262 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaatctcatcagtcaagtattggaygatcggatccatccagcttggttcg

SEQ ID NO: 1263 - DNA, 50 bp, Artificial Sequence
  synthetic Elaeis guineensis (oil palm) single nucleotide polymorphism (SNP) in genomic region adjacent to shatterproof1 (SHELL) shell thickness gene
atctttcactttctaaagatacttyatcatagtggggtctcaggcttcaa

SEQ ID NO: 1264 - DNA, 50 bp, Artificial Sequence
  synthetic Elaeis guineensis (oil palm) single nucleotide polymorphism (SNP) in genomic region adjacent to shatterproof1 (SHELL) shell thickness gene
cacccttgacttgtccaacaatccrttgtgagtcggtgaagaccttcaaa

SEQ ID NO: 1265 - DNA, 50 bp, Artificial Sequence
  synthetic Elaeis guineensis (oil palm) single nucleotide polymorphism (SNP) in genomic region adjacent to shatterproof1 (SHELL) shell thickness gene
agaaatgaatcgactgagtgcgacratccttccattgagttactgtatct

SEQ ID NO: 1266 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcgggtttaacttcatctgatatcrtcgaagtgtgccaaaggctttctcc

SEQ ID NO: 1267 - DNA, 50 bp, Artificial Sequence
  synthetic Elaeis guineensis (oil palm) single nucleotide polymorphism (SNP) in genomic region adjacent to shatterproof1 (SHELL) shell thickness gene
caaaggctttctccagatctcgaayatgatctgaagtttggagactcttc

SEQ ID NO: 1268 - DNA, 50 bp, Artificial Sequence
  synthetic Elaeis guineensis (oil palm) single nucleotide polymorphism (SNP) in genomic region adjacent to shatterproof1 (SHELL) shell thickness gene
cttcatatttcatccaatctgggcyttgaagatcttattgacgagccgtt

SEQ ID NO: 1269 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctgggccttgaagatcttattgacragccgttgataagtagctccgatat

SEQ ID NO: 1270 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgacgagccgttgataagtagctcygatatttttcaaactgaaaggcatt

SEQ ID NO: 1271 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgataagtagctccgatatttttcraactgaaaggcattactttgtaaca

SEQ ID NO: 1272 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtcggttacaaaagtcgtgtgctcytcatcttttagtgccatccagattt

SEQ ID NO: 1273 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtgccatccagatttgattataccygacgaaggtatccatgaaactcaaa

SEQ ID NO: 1274 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatttttcattggcttttctcaccrttaccacattggcgagtcaatcgag

SEQ ID NO: 1275 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcatccgagtatggcattatgagcygaaggtactcgaactatcgtgaacg

SEQ ID NO: 1276 - DNA, 50 bp, Artificial Sequence
  synthetic Elaeis guineensis (oil palm) single nucleotide polymorphism (SNP) in genomic region adjacent to shatterproof1 (SHELL) shell thickness gene
atggcgtcaagactcttctgagtcrtcagtcggtagtcgcattcgagaga

SEQ ID NO: 1277 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaacttttattatctacaataattytttttacatcataatttgctattgt

SEQ ID NO: 1278 - DNA, 50 bp, Artificial Sequence
  synthetic Elaeis guineensis (oil palm) single nucleotide polymorphism (SNP) in genomic region adjacent to shatterproof1 (SHELL) shell thickness gene
agacaacaacagcatcatcatgggragtttgaattctccaaacatcctct

SEQ ID NO: 1279 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttgaattctccaaacatcctcttcygaaaaaattattacattgttgagtc

SEQ ID NO: 1280 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaaaattattacattgttgagtcrtcgtcgtttcaccgactcttcttca

SEQ ID NO: 1281 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttcaccgactcttcttcagtagttkccctcaagtccagtcgttcggagat

SEQ ID NO: 1282 - DNA, 50 bp, Artificial Sequence
  synthetic Elaeis guineensis (oil palm) single nucleotide polymorphism (SNP) in genomic region adjacent to shatterproof1 (SHELL) shell thickness gene
gatattttttgaagtagcctcattraatcagggcttctatctcatccctg

SEQ ID NO: 1283 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttaaatcagggcttctatctcatcyctgagttgaatgcattattcggtat

SEQ ID NO: 1284 - DNA, 50 bp, Artificial Sequence
  synthetic Elaeis guineensis (oil palm) single nucleotide polymorphism (SNP) in genomic region adjacent to shatterproof1 (SHELL) shell thickness gene
taaatcagggcttctatctcatccmtgagttgaatgcattattcggtatc

SEQ ID NO: 1285 - DNA, 50 bp, Artificial Sequence
  synthetic Elaeis guineensis (oil palm) single nucleotide polymorphism (SNP) in genomic region adjacent to shatterproof1 (SHELL) shell thickness gene
atcacgatggaaccgacaatacttycttcgattgcgattccttaatgatg

SEQ ID NO: 1286 - DNA, 50 bp, Artificial Sequence
  synthetic Elaeis guineensis (oil palm) single nucleotide polymorphism (SNP) in genomic region adjacent to shatterproof1 (SHELL) shell thickness gene
acggagagcaaaaagaggagtgtaraagtcatacctgctgtaattcagcc

SEQ ID NO: 1287 - DNA, 50 bp, Artificial Sequence
  synthetic Elaeis guineensis (oil palm) single nucleotide polymorphism (SNP) in genomic region adjacent to shatterproof1 (SHELL) shell thickness gene
gggcgaagcttgcttattggatggsggccgacttgattcagccagagctt

SEQ ID NO: 1288 - DNA, 50 bp, Artificial Sequence
  synthetic Elaeis guineensis (oil palm) single nucleotide polymorphism (SNP) in genomic region adjacent to shatterproof1 (SHELL) shell thickness gene
cttttgtttcttcttcttctaaccrttgccttttgtcgggcgtcggccag

SEQ ID NO: 1289 - DNA, 50 bp, Artificial Sequence
  synthetic Elaeis guineensis (oil palm) single nucleotide polymorphism (SNP) in genomic region adjacent to shatterproof1 (SHELL) shell thickness gene
atttgtgacggccttcgactgctamtgaagtgagccacgaaagagtgttc

SEQ ID NO: 1290 - DNA, 50 bp, Artificial Sequence
  synthetic Elaeis guineensis (oil palm) single nucleotide polymorphism (SNP) in genomic region adjacent to shatterproof1 (SHELL) shell thickness gene
gagccacgaaagagtgttcgagctrtccaaaggagtatatacttttcgat

SEQ ID NO: 1291 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctttctgaagagtcgctggaaagtygatgcacaagagggcgttggtcacc

SEQ ID NO: 1292 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcgatgcacaagagggcgttggtcrccccctgaatcatcatgagagcctt

SEQ ID NO: 1293 - DNA, 50 bp, Artificial Sequence
  synthetic Elaeis guineensis (oil palm) single nucleotide polymorphism (SNP) in genomic region adjacent to shatterproof1 (SHELL) shell thickness gene
atggtcgatcgaatcagtggagccrtcatatggctccacttacagtattt

SEQ ID NO: 1294 - DNA, 50 bp, Artificial Sequence
  synthetic Elaeis guineensis (oil palm) single nucleotide polymorphism (SNP) in genomic region adjacent to shatterproof1 (SHELL) shell thickness gene
agccgtcatatggctccacttacartattttgaactgagatgggatcggc

SEQ ID NO: 1295 - DNA, 50 bp, Artificial Sequence
  synthetic Elaeis guineensis (oil palm) single nucleotide polymorphism (SNP) in genomic region adjacent to shatterproof1 (SHELL) shell thickness gene
gctggaaaactctgagggtagaacyccctgacgagcttgagggagaagca

SEQ ID NO: 1296 - DNA, 50 bp, Artificial Sequence
  synthetic Elaeis guineensis (oil palm) single nucleotide polymorphism (SNP) in genomic region adjacent to shatterproof1 (SHELL) shell thickness gene
cgatcatttttccttcctaatacgrtcgagatgggaaggagaggaatgtc

SEQ ID NO: 1297 - DNA, 50 bp, Artificial Sequence
  synthetic Elaeis guineensis (oil palm) single nucleotide polymorphism (SNP) in genomic region adjacent to shatterproof1 (SHELL) shell thickness gene
gggctctggtcttcgtcatggtgtrtatgatctttaccccttcctgacat

SEQ ID NO: 1298 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcgtcatggtgtgtatgatctttaycccttcctgacataccaatctgttg

SEQ ID NO: 1299 - DNA, 50 bp, Artificial Sequence
  synthetic Elaeis guineensis (oil palm) single nucleotide polymorphism (SNP) in genomic region adjacent to shatterproof1 (SHELL) shell thickness gene
gatgattctggtgtaatcatcgagyacatgatcctattttttatgatgct

SEQ ID NO: 1300 - DNA, 50 bp, Artificial Sequence
  synthetic Elaeis guineensis (oil palm) single nucleotide polymorphism (SNP) in genomic region adjacent to shatterproof1 (SHELL) shell thickness gene
gggtgtttatttttcttaatagccrtgacatgtagttgataaccgtttgt

SEQ ID NO: 1301 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtgacggttatggtattttgagcarattagccgatcatatatcggtagaa

SEQ ID NO: 1302 - DNA, 50 bp, Artificial Sequence
  synthetic Elaeis guineensis (oil palm) single nucleotide polymorphism (SNP) in genomic region adjacent to shatterproof1 (SHELL) shell thickness gene
cggtcagccgacagtaagtcggtgyagttcgcttagtcagtcgataaaga

SEQ ID NO: 1303 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaatgattattatcgtgtaaaaagwttttctctctctctctcattctctc

SEQ ID NO: 1304 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgtaaaaagattttctctctctctmtcattctctcattgtgtctctctcc

SEQ ID NO: 1305 - DNA, 50 bp, Artificial Sequence
  synthetic Elaeis guineensis (oil palm) single nucleotide polymorphism (SNP) in genomic region adjacent to shatterproof1 (SHELL) shell thickness gene
cacaggttattcggttgtagattakatctataaaggacataagttatgga

SEQ ID NO: 1306 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgtttatttactttataattttcawtttaaatatgatgaatctggtaaat

SEQ ID NO: 1307 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctggtaaattggcaattcactgcmcttgatattacgggcaagaattacc

SEQ ID NO: 1308 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggtacggcatgattggatgcacttraggttgcaagattttaaaactatgt

SEQ ID NO: 1309 - DNA, 50 bp, Artificial Sequence
  synthetic Elaeis guineensis (oil palm) single nucleotide polymorphism (SNP) in genomic region adjacent to shatterproof1 (SHELL) shell thickness gene
tggatgaggtcgtgggcatggccayggtggtttcaaaaatattgggacaa

SEQ ID NO: 1310 - DNA, 50 bp, Artificial Sequence
  synthetic Elaeis guineensis (oil palm) single nucleotide polymorphism (SNP) in genomic region adjacent to shatterproof1 (SHELL) shell thickness gene
atgatggcaatccaaatgtgcctcmttttgatgtcttcgatttttttgcc

SEQ ID NO: 1311 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaattgactacatgatcattgatrgagaaatagttaaagaataattttt

SEQ ID NO: 1312 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaagagcaactataatactgtcagrtggtacaaagttagaaatcaacgaa

SEQ ID NO: 1313 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtgcatcattttttatgattcaaayagaaaacttgagttaaaaaattttt

SEQ ID NO: 1314 - DNA, 50 bp, Artificial Sequence
  synthetic Elaeis guineensis (oil palm) single nucleotide polymorphism (SNP) in genomic region adjacent to shatterproof1 (SHELL) shell thickness gene
caaacagaaaacttgagttaaaaawtttttttgttctttcgccaggattg

SEQ ID NO: 1315 - DNA, 50 bp, Artificial Sequence
  synthetic Elaeis guineensis (oil palm) single nucleotide polymorphism (SNP) in genomic region adjacent to shatterproof1 (SHELL) shell thickness gene
aataaatataatattgaaccagaakttcactaaaaaagaaatgtttattc

SEQ ID NO: 1316 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaaaggattcaacgagacatatatrgtccaattcatctcccttgtggacc

SEQ ID NO: 1317 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctcatattctagctgaaatactcyagctcggataaaagtttcaatagga

SEQ ID NO: 1318 - DNA, 50 bp, Artificial Sequence
  synthetic Elaeis guineensis (oil palm) single nucleotide polymorphism (SNP) in genomic region adjacent to shatterproof1 (SHELL) shell thickness gene
taaattataaataaataaaagttaytttggtattttttcatcataaatgt

SEQ ID NO: 1319 - DNA, 50 bp, Artificial Sequence
  synthetic Elaeis guineensis (oil palm) single nucleotide polymorphism (SNP) in genomic region adjacent to shatterproof1 (SHELL) shell thickness gene
agttactttggtattttttcatcayaaatgtttcatcttctaatgaactc

SEQ ID NO: 1320 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctcctgtgttgtggtgaagtccttrggactatttagactcgataaaggaa

SEQ ID NO: 1321 - DNA, 50 bp, Artificial Sequence
  synthetic Elaeis guineensis (oil palm) single nucleotide polymorphism (SNP) in genomic region adjacent to shatterproof1 (SHELL) shell thickness gene
agactcgataaaggaagatttgtcrcttagtccttaaacctgtttgcgac

SEQ ID NO: 1322 - DNA, 50 bp, Artificial Sequence
  synthetic Elaeis guineensis (oil palm) single nucleotide polymorphism (SNP) in genomic region adjacent to shatterproof1 (SHELL) shell thickness gene
agatttgtcgcttagtccttaaacmtgtttgcgaccaaatgatacgttgt

SEQ ID NO: 1323 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgtcgcttagtccttaaacctgttygcgaccaaatgatacgttgttacca

SEQ ID NO: 1324 - DNA, 50 bp, Artificial Sequence
  synthetic Elaeis guineensis (oil palm) single nucleotide polymorphism (SNP) in genomic region adjacent to shatterproof1 (SHELL) shell thickness gene
cacttacaccctatgggtttcattmcttcgggtgagtcaaccaatgtcca

SEQ ID NO: 1325 - DNA, 50 bp, Artificial Sequence
  synthetic Elaeis guineensis (oil palm) single nucleotide polymorphism (SNP) in genomic region adjacent to shatterproof1 (SHELL) shell thickness gene
tccacttacaccctatgggtttcaytacttcgggtgagtcaaccaatgtc

SEQ ID NO: 1326 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctgcgcccctcttcctcttgaagayccacttacaccctatgggtttcatt

SEQ ID NO: 1327 - DNA, 50 bp, Artificial Sequence
  synthetic Elaeis guineensis (oil palm) single nucleotide polymorphism (SNP) in genomic region adjacent to shatterproof1 (SHELL) shell thickness gene
gataatttatttaacctgtttaacytatttaatctatttctgatctattt

SEQ ID NO: 1328 - DNA, 50 bp, Artificial Sequence
  synthetic Elaeis guineensis (oil palm) single nucleotide polymorphism (SNP) in genomic region adjacent to shatterproof1 (SHELL) shell thickness gene
atcgaatttgaattttagatatctkatccatttaatccgtttaacccatt

SEQ ID NO: 1329 - DNA, 50 bp, Artificial Sequence
  synthetic Elaeis guineensis (oil palm) single nucleotide polymorphism (SNP) in genomic region adjacent to shatterproof1 (SHELL) shell thickness gene
atttgggtcataaatggatcgatcyatttaatctatttaataattagatc

SEQ ID NO: 1330 - DNA, 50 bp, Artificial Sequence
  synthetic Elaeis guineensis (oil palm) single nucleotide polymorphism (SNP) in genomic region adjacent to shatterproof1 (SHELL) shell thickness gene
acaggtttaggtttaggctaaacaratttgggtcataaatggatcgatcc

SEQ ID NO: 1331 - DNA, 50 bp, Artificial Sequence
  synthetic Elaeis guineensis (oil palm) single nucleotide polymorphism (SNP) in genomic region adjacent to shatterproof1 (SHELL) shell thickness gene
ataaatttactgcaaaggcaatatyaggttggatataattagtaagatac

SEQ ID NO: 1332 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagttgcaaccattgtctgttttayaaattttcatgagatggcacagtca

SEQ ID NO: 1333 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtaaaatatgtttagttcaatctcytttgataaatcttcttttaacttgt

SEQ ID NO: 1334 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttacaaagaaaaataatatttctcrttcatttacaaaagaaaataatatt

SEQ ID NO: 1335 - DNA, 50 bp, Artificial Sequence
  synthetic Elaeis guineensis (oil palm) single nucleotide polymorphism (SNP) in genomic region adjacent to shatterproof1 (SHELL) shell thickness gene
agagagaggaaatcttttcatacgrtaataatccttctcatttcattcca

SEQ ID NO: 1336 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgaacacacatttaaatattcaaayatattgtagaataataaaatatata

SEQ ID NO: 1337 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaatatttaaatttatatataattwtatataattttatatagtatttatt

SEQ ID NO: 1338 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgtaacaggcagaagcaaaggaacygcataccttgatctaaaagcctgct

SEQ ID NO: 1339 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttatctgactgatgggataagcawggcagtaaaaactcaaagactttta

SEQ ID NO: 1340 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcatagagccttgtctcagctatcwggagtttgcttaatggatcctcatt

SEQ ID NO: 1341 - DNA, 50 bp, Artificial Sequence
  synthetic Elaeis guineensis (oil palm) single nucleotide polymorphism (SNP) in genomic region adjacent to shatterproof1 (SHELL) shell thickness gene
cccaggttggtatcaaaatgtcacrggttcaaatccccatttagaccatt

SEQ ID NO: 1342 - DNA, 50 bp, Artificial Sequence
  synthetic Elaeis guineensis (oil palm) single nucleotide polymorphism (SNP) in genomic region adjacent to shatterproof1 (SHELL) shell thickness gene
cttgagtcatgcatggtccaggctrcatgtggttttagcagcataagcat

SEQ ID NO: 1343 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtattatgaagtaataccaattgakaaaatattataaagtaatagtcaaa

SEQ ID NO: 1344 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaagtacatgtcacaaacatggttyaatatgattaaagtaataggcaagt

SEQ ID NO: 1345 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagtacatgtcacaaacatggttcratatgattaaagtaataggcaagtg

SEQ ID NO: 1346 - DNA, 50 bp, Artificial Sequence
  synthetic Elaeis guineensis (oil palm) single nucleotide polymorphism (SNP) in genomic region adjacent to shatterproof1 (SHELL) shell thickness gene
aacatgacattactctcacatgtaygataactttattcaaaaaaataaag

SEQ ID NO: 1347 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgtatttccatgttagattcctatyataaggaagctcgcaaaaaaaatat

SEQ ID NO: 1348 - DNA, 50 bp, Artificial Sequence
  synthetic Elaeis guineensis (oil palm) single nucleotide polymorphism (SNP) in genomic region adjacent to shatterproof1 (SHELL) shell thickness gene
atcataaggaagctcgcaaaaaaawtatgatttgatgaattttttttctc

SEQ ID NO: 1349 - DNA, 50 bp, Artificial Sequence
  synthetic Elaeis guineensis (oil palm) single nucleotide polymorphism (SNP) in genomic region adjacent to shatterproof1 (SHELL) shell thickness gene
gatgatcagcaaaacgaaataataygaggtaaggttcagcaaatttaaac

SEQ ID NO: 1350 - DNA, 50 bp, Artificial Sequence
  synthetic Elaeis guineensis (oil palm) single nucleotide polymorphism (SNP) in genomic region adjacent to shatterproof1 (SHELL) shell thickness gene
gagcacattgcttttctctagctcyacatgatcatcgattttagcctcaa

SEQ ID NO: 1351 - DNA, 50 bp, Artificial Sequence
  synthetic Elaeis guineensis (oil palm) single nucleotide polymorphism (SNP) in genomic region adjacent to shatterproof1 (SHELL) shell thickness gene
agtatttcttaagaacaggggtggsaatttctgacccagaccccacagac

SEQ ID NO: 1352 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcaccttaaataaacaagtttcaakgatgtgtttttataataaggttttg

SEQ ID NO: 1353 - DNA, 50 bp, Artificial Sequence
  synthetic Elaeis guineensis (oil palm) single nucleotide polymorphism (SNP) in genomic region adjacent to shatterproof1 (SHELL) shell thickness gene
aacaagtttcaatgatgtgtttttwtaataaggttttgtttcaggttaac

SEQ ID NO: 1354 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttcaggttaaccaagaccaatctrattacaacttggtcaggcttggttt

SEQ ID NO: 1355 - DNA, 50 bp, Artificial Sequence
  synthetic Elaeis guineensis (oil palm) single nucleotide polymorphism (SNP) in genomic region adjacent to shatterproof1 (SHELL) shell thickness gene
agtaccggtaatctagttgaggctyaattgcatgattagggaggctatat

SEQ ID NO: 1356 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttccacttaatttcctctctctcygcatgtgtgtgcatttggattcaca

SEQ ID NO: 1357 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttggccctatttcagttttgtttrtaaaggtatataattgaaaagtgaa

SEQ ID NO: 1358 - DNA, 50 bp, Artificial Sequence
  synthetic Elaeis guineensis (oil palm) single nucleotide polymorphism (SNP) in genomic region adjacent to shatterproof1 (SHELL) shell thickness gene
caaaatgggttttgacccaacctamatataacccacccaatgccactgct

SEQ ID NO: 1359 - DNA, 50 bp, Artificial Sequence
  synthetic Elaeis guineensis (oil palm) single nucleotide polymorphism (SNP) in genomic region adjacent to shatterproof1 (SHELL) shell thickness gene
cccaatgccactgctactcaagaawgaaaataaggatataacaaaccctt

SEQ ID NO: 1360 - DNA, 50 bp, Artificial Sequence
  synthetic Elaeis guineensis (oil palm) single nucleotide polymorphism (SNP) in genomic region adjacent to shatterproof1 (SHELL) shell thickness gene
ataaaaaagacaaaggttcatacamctaaaaaattatccatataatcact

SEQ ID NO: 1361 - DNA, 50 bp, Artificial Sequence
  synthetic Elaeis guineensis (oil palm) single nucleotide polymorphism (SNP) in genomic region adjacent to shatterproof1 (SHELL) shell thickness gene
aataatccattagagaaacaaagaygtagataatcaccttcttcatgcga

SEQ ID NO: 1362 - DNA, 50 bp, Artificial Sequence
  synthetic Elaeis guineensis (oil palm) single nucleotide polymorphism (SNP) in genomic region adjacent to shatterproof1 (SHELL) shell thickness gene
agaaacaaagacgtagataatcacmttcttcatgcgagagccaagaaaca

SEQ ID NO: 1363 - DNA, 50 bp, Artificial Sequence
  synthetic Elaeis guineensis (oil palm) single nucleotide polymorphism (SNP) in genomic region adjacent to shatterproof1 (SHELL) shell thickness gene
gattaagttttgtgacttttagcawcagtagttcaaagtaactatatact

SEQ ID NO: 1364 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccaaattaagcaaacttctgaaaawgtggactccatattaaaggtgaatg

SEQ ID NO: 1365 - DNA, 50 bp, Artificial Sequence
  synthetic Elaeis guineensis (oil palm) single nucleotide polymorphism (SNP) in genomic region adjacent to shatterproof1 (SHELL) shell thickness gene
attaagcaaacttctgaaaatgtgsactccatattaaaggtgaatgaaat

SEQ ID NO: 1366 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctcaaattctgggctcataatattragttctcaatcagcttgataacata

SEQ ID NO: 1367 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtactaagcacgacgctttggtatkgcacatgatgtggcaccagctcaag

SEQ ID NO: 1368 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcacgacgctttggtattgcacatkatgtggcaccagctcaagtaaaacc

SEQ ID NO: 1369 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctctcatacgtacctagtggtgttyggccaaccataaggagagggaaaga

SEQ ID NO: 1370 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcacaagttgagggaagctaaactyctctttaatgtagttgtatagattt

SEQ ID NO: 1371 - DNA, 50 bp, Artificial Sequence
  synthetic Elaeis guineensis (oil palm) single nucleotide polymorphism (SNP) in genomic region adjacent to shatterproof1 (SHELL) shell thickness gene
acaagttgagggaagctaaacttcyctttaatgtagttgtatagatttcc

SEQ ID NO: 1372 - DNA, 50 bp, Artificial Sequence
  synthetic Elaeis guineensis (oil palm) single nucleotide polymorphism (SNP) in genomic region adjacent to shatterproof1 (SHELL) shell thickness gene
acttgaacttgtgttaccctctctmtctttccagatgtgaatatgggaca

SEQ ID NO: 1373 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggagggaaaaagaaaggatggagtktgtgggagtgggacttgcagtgttt

SEQ ID NO: 1374 - DNA, 50 bp, Artificial Sequence
  synthetic Elaeis guineensis (oil palm) single nucleotide polymorphism (SNP) in genomic region adjacent to shatterproof1 (SHELL) shell thickness gene
caatgtatttaggcatctattatcrtctagtgaaacaaaggaaatgggaa

SEQ ID NO: 1375 - DNA, 50 bp, Artificial Sequence
  synthetic Elaeis guineensis (oil palm) single nucleotide polymorphism (SNP) in genomic region adjacent to shatterproof1 (SHELL) shell thickness gene
tagatgccatcccaatagtagtccyatgcatatttagtcaagccctacgt

SEQ ID NO: 1376 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccactaaatacctaggttcccggtrtctcactccttgaattaatttatca

SEQ ID NO: 1377 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaggaagcaagagatgcagatttgygggggactcagatgtgcaggactgc

SEQ ID NO: 1378 - DNA, 50 bp, Artificial Sequence
  synthetic Elaeis guineensis (oil palm) single nucleotide polymorphism (SNP) in genomic region adjacent to shatterproof1 (SHELL) shell thickness gene
atacacagaaaaaaaatggaccctyaaacaaccacaccgaatgcttattg

SEQ ID NO: 1379 - DNA, 50 bp, Artificial Sequence
  synthetic Elaeis guineensis (oil palm) single nucleotide polymorphism (SNP) in genomic region adjacent to shatterproof1 (SHELL) shell thickness gene
agtctttcaaaaatgcaacaaaaaraaaaatgtagatcgttcaatttgaa

SEQ ID NO: 1380 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccccttgcagatctccttcggcgtyggcagatccttccctaaattcgacc

SEQ ID NO: 1381 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttgggcaagcttgccaatgaaagmctagttttgtctagcttcgtatata

SEQ ID NO: 1382 - DNA, 50 bp, Artificial Sequence
  synthetic Elaeis guineensis (oil palm) single nucleotide polymorphism (SNP) in genomic region adjacent to shatterproof1 (SHELL) shell thickness gene
catgatacaaaataactattagatyactcgagaagataggaaagaattgt

SEQ ID NO: 1383 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttgttaggcatctttagaaaaatracttttgtaagttaattttgtttta

SEQ ID NO: 1384 - DNA, 50 bp, Artificial Sequence
  synthetic Elaeis guineensis (oil palm) single nucleotide polymorphism (SNP) in genomic region adjacent to shatterproof1 (SHELL) shell thickness gene
gttaattttgttttagtataaattwtgaaactactggcatattactcaca

SEQ ID NO: 1385 - DNA, 50 bp, Artificial Sequence
  synthetic Elaeis guineensis (oil palm) single nucleotide polymorphism (SNP) in genomic region adjacent to shatterproof1 (SHELL) shell thickness gene
atataattttttagacattaatatytattctattattatataaaattttt

SEQ ID NO: 1386 - DNA, 50 bp, Artificial Sequence
  synthetic Elaeis guineensis (oil palm) single nucleotide polymorphism (SNP) in genomic region adjacent to shatterproof1 (SHELL) shell thickness gene
atataaaatttttattttattgatraatgtatttattgatttttattaaa

SEQ ID NO: 1387 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatatattattttatcaatataaawtttaatttattaatatattattaat

SEQ ID NO: 1388 - DNA, 50 bp, Artificial Sequence
  synthetic Elaeis guineensis (oil palm) single nucleotide polymorphism (SNP) in genomic region adjacent to shatterproof1 (SHELL) shell thickness gene
atcattaaccctaacttatgcataygtaggatccaaaccagatcaccaaa

SEQ ID NO: 1389 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaccagatcaccaaaaccaacttycggtgagctagttggcatccattat

SEQ ID NO: 1390 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttgatacgctttctctctctctctmtatatatatatatatattgatcatt

SEQ ID NO: 1391 - DNA, 50 bp, Artificial Sequence
  synthetic Elaeis guineensis (oil palm) single nucleotide polymorphism (SNP) in genomic region adjacent to shatterproof1 (SHELL) shell thickness gene
gagttgactcatgattcgatccagyctgacccgtttagatccgatcctat

SEQ ID NO: 1392 - DNA, 50 bp, Artificial Sequence
  synthetic Elaeis guineensis (oil palm) single nucleotide polymorphism (SNP) in genomic region adjacent to shatterproof1 (SHELL) shell thickness gene
tggatcatttgaatatttgcatatmtcatactctccaagcatcatcttct

SEQ ID NO: 1393 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaagagtctggattgaattttatgrgattggaccatttatattctactcc

SEQ ID NO: 1394 - DNA, 50 bp, Artificial Sequence
  synthetic Elaeis guineensis (oil palm) single nucleotide polymorphism (SNP) in genomic region adjacent to shatterproof1 (SHELL) shell thickness gene
agaatgggagtaacccattccattyctattttaggccccaattctctcca

SEQ ID NO: 1395 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaatcgaaatataatttaaataatygggaagagtagagaatagattttga

SEQ ID NO: 1396 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatcgaaatataatttaaataatcrggaagagtagagaatagattttgag

SEQ ID NO: 1397 - DNA, 50 bp, Artificial Sequence
  synthetic Elaeis guineensis (oil palm) single nucleotide polymorphism (SNP) in genomic region adjacent to shatterproof1 (SHELL) shell thickness gene
attgaaaaattttctcaaaaattgraatggaaatagaactttctctaacc

SEQ ID NO: 1398 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgctcgttctcattcccatttgagrctccaactcccttcaactagatgtc

SEQ ID NO: 1399 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctttcgttcagaaaattttaacatrttcaacctgaaaggaggtatccctg

SEQ ID NO: 1400 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaggcattcaagctgccatagctwtcttgcaagctacctcactagagat

SEQ ID NO: 1401 - DNA, 50 bp, Artificial Sequence
  synthetic Elaeis guineensis (oil palm) single nucleotide polymorphism (SNP) in genomic region adjacent to shatterproof1 (SHELL) shell thickness gene
atcacttgcctttattctcctgggrcaattgcttcctctttgaatccttt

SEQ ID NO: 1402 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctcctggggcaattgcttcctctktgaatcctttgcttctggatgcttg

SEQ ID NO: 1403 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttctttgaggaatccaaaacttgcktttttttcccatctatgaaggaaac

SEQ ID NO: 1404 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgggccaaaacaggagagacaagarctcacattttaggtaaaacatacaa

SEQ ID NO: 1405 - DNA, 50 bp, Artificial Sequence
  synthetic Elaeis guineensis (oil palm) single nucleotide polymorphism (SNP) in genomic region adjacent to shatterproof1 (SHELL) shell thickness gene
cctgagttgaaatcaagcggagtgygtatgggaacccaatcatggactag

SEQ ID NO: 1406 - DNA, 50 bp, Artificial Sequence
  synthetic Elaeis guineensis (oil palm) single nucleotide polymorphism (SNP) in genomic region adjacent to shatterproof1 (SHELL) shell thickness gene
cccctctgttagatgacaagaattmctcatttcgaaggttggatgatgca

SEQ ID NO: 1407 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttctcattgtcttttattttttttwtttagtttatttagtagtattgctt

SEQ ID NO: 1408 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaataaataactaagtaaatgaagsttcgagggccattttttgtgagaaa

SEQ ID NO: 1409 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaataactaagtaaatgaagcttcragggccattttttgtgagaaagttg

SEQ ID NO: 1410 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtatttcaaaaggtatgaagttcasgtcagccctatacctatttctagtt

SEQ ID NO: 1411 - DNA, 50 bp, Artificial Sequence
  synthetic Elaeis guineensis (oil palm) single nucleotide polymorphism (SNP) in genomic region adjacent to shatterproof1 (SHELL) shell thickness gene
caaaaggtatgaagttcacgtcagmcctatacctatttctagtttgttct

SEQ ID NO: 1412 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctcacctaaatggcctaaaaataytactccacttaaccctcttgaaaac

SEQ ID NO: 1413 - DNA, 50 bp, Artificial Sequence
  synthetic Elaeis guineensis (oil palm) single nucleotide polymorphism (SNP) in genomic region adjacent to shatterproof1 (SHELL) shell thickness gene
acctaaatggcctaaaaatattacyccacttaaccctcttgaaaaccaac

SEQ ID NO: 1414 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcttcctcacttatgagtgcacacyattgagaaggcctgttgtatcctga

SEQ ID NO: 1415 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctcacttatgagtgcacactattgrgaaggcctgttgtatcctgagggat

SEQ ID NO: 1416 - DNA, 50 bp, Artificial Sequence
  synthetic Elaeis guineensis (oil palm) single nucleotide polymorphism (SNP) in genomic region adjacent to shatterproof1 (SHELL) shell thickness gene
taaaggatagaaatggatcccactrctactagtaccattgccgctagttc

SEQ ID NO: 1417 - DNA, 50 bp, Artificial Sequence
  synthetic Elaeis guineensis (oil palm) single nucleotide polymorphism (SNP) in genomic region adjacent to shatterproof1 (SHELL) shell thickness gene
cccactactactagtaccattgccrctagttcctccaatgctacatccac

SEQ ID NO: 1418 - DNA, 50 bp, Artificial Sequence
  synthetic Elaeis guineensis (oil palm) single nucleotide polymorphism (SNP) in genomic region adjacent to shatterproof1 (SHELL) shell thickness gene
gccataccgttgcttcctaccatayctctcactgcacatgaggggtttcc

SEQ ID NO: 1419 - DNA, 50 bp, Artificial Sequence
  synthetic Elaeis guineensis (oil palm) single nucleotide polymorphism (SNP) in genomic region adjacent to shatterproof1 (SHELL) shell thickness gene
ataccagcaatatagagaactggargcatgcaaataagacgttggccaac

SEQ ID NO: 1420 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgaagataaggatatcaagatgcaratcaacgagtaccacaagctgatag

SEQ ID NO: 1421 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatagctggcatgctgatcgaaaarctgcccaactcgtggagcgactaca

SEQ ID NO: 1422 - DNA, 50 bp, Artificial Sequence
  synthetic Elaeis guineensis (oil palm) single nucleotide polymorphism (SNP) in genomic region adjacent to shatterproof1 (SHELL) shell thickness gene
acaagcaacaactcaagcacaagtrcaaggagatgtcgttggaagatttg

SEQ ID NO: 1423 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggagaagaaactatttacttaggtractcaaaatctacacaagttcttgg

SEQ ID NO: 1424 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttctcaagctcacctcaggcaagayattggcattgaatgaagtgctccat

SEQ ID NO: 1425 - DNA, 50 bp, Artificial Sequence
  synthetic Elaeis guineensis (oil palm) single nucleotide polymorphism (SNP) in genomic region adjacent to shatterproof1 (SHELL) shell thickness gene
cagagactctttgtactttatattrttgaagtaattaatgaaaatgcatg

SEQ ID NO: 1426 - DNA, 50 bp, Artificial Sequence
  synthetic Elaeis guineensis (oil palm) single nucleotide polymorphism (SNP) in genomic region adjacent to shatterproof1 (SHELL) shell thickness gene
ataatgcttgcatgaacaagtgtgraatttatgctgaaaccaaaacaact

SEQ ID NO: 1427 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttatgctgaaaccaaaacaactaraaaaacttatgcatttgtggaaaga

SEQ ID NO: 1428 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatgcatttgtggaaagagaatctraacttttaggattaattcatactga

SEQ ID NO: 1429 - DNA, 50 bp, Artificial Sequence
  synthetic Elaeis guineensis (oil palm) single nucleotide polymorphism (SNP) in genomic region adjacent to shatterproof1 (SHELL) shell thickness gene
attgatgattattctaggtatactragatttatttattgaggaataaaga

SEQ ID NO: 1430 - DNA, 50 bp, Artificial Sequence
  synthetic Elaeis guineensis (oil palm) single nucleotide polymorphism (SNP) in genomic region adjacent to shatterproof1 (SHELL) shell thickness gene
gattccatataaaaacaccgataasataccttttgaattgtggaagggtt

SEQ ID NO: 1431 - DNA, 50 bp, Artificial Sequence
  synthetic Elaeis guineensis (oil palm) single nucleotide polymorphism (SNP) in genomic region adjacent to shatterproof1 (SHELL) shell thickness gene
atactgatcatagtgcagcatatargtttcttgttttgaaaaatggcatg

SEQ ID NO: 1432 - DNA, 50 bp, Artificial Sequence
  synthetic Elaeis guineensis (oil palm) single nucleotide polymorphism (SNP) in genomic region adjacent to shatterproof1 (SHELL) shell thickness gene
catagtgcagcatataagtttcttrttttgaaaaatggcatgcttgagtg

SEQ ID NO: 1433 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttagaaatgatttttgtatctatyttattgataaagatcctgtgtcttt

SEQ ID NO: 1434 - DNA, 50 bp, Artificial Sequence
  synthetic Elaeis guineensis (oil palm) single nucleotide polymorphism (SNP) in genomic region adjacent to shatterproof1 (SHELL) shell thickness gene
agaaatgatttttgtatctattttrttgataaagatcctgtgtctttttc

SEQ ID NO: 1435 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcaaaaatgaacttgattcaatttyacataatcaaacttaagaactagtt

SEQ ID NO: 1436 - DNA, 50 bp, Artificial Sequence
  synthetic Elaeis guineensis (oil palm) single nucleotide polymorphism (SNP) in genomic region adjacent to shatterproof1 (SHELL) shell thickness gene
aacaaaatgtgcaaattgagaaaakctttatatagtttaaaacaagctcc

SEQ ID NO: 1437 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttaaaacaagctccaaaacaatgrcataagaaatttgatagagttttaa

SEQ ID NO: 1438 - DNA, 50 bp, Artificial Sequence
  synthetic Elaeis guineensis (oil palm) single nucleotide polymorphism (SNP) in genomic region adjacent to shatterproof1 (SHELL) shell thickness gene
gagttttaatggatatcagattttyttctattggagtagataaatgtgtg

SEQ ID NO: 1439 - DNA, 50 bp, Artificial Sequence
  synthetic Elaeis guineensis (oil palm) single nucleotide polymorphism (SNP) in genomic region adjacent to shatterproof1 (SHELL) shell thickness gene
tacaccaagactattgataatgacygtgtgattatcaatttgtatgtgga

SEQ ID NO: 1440 - DNA, 50 bp, Artificial Sequence
  synthetic Elaeis guineensis (oil palm) single nucleotide polymorphism (SNP) in genomic region adjacent to shatterproof1 (SHELL) shell thickness gene
aattgtgaaagaaacaaaaggtttyttagcctcccaatttgacatgaaag

SEQ ID NO: 1441 - DNA, 50 bp, Artificial Sequence
  synthetic Elaeis guineensis (oil palm) single nucleotide polymorphism (SNP) in genomic region adjacent to shatterproof1 (SHELL) shell thickness gene
atgaaagatatgggagaagccaatrtgattttaggtgttaaaatcataag

SEQ ID NO: 1442 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatgggagaagccaatatgattttrggtgttaaaatcataagagatatga

SEQ ID NO: 1443 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctgtttgtactccttatgatgctartactcaattaaaaaagaagagaggt

SEQ ID NO: 1444 - DNA, 50 bp, Artificial Sequence
  synthetic Elaeis guineensis (oil palm) single nucleotide polymorphism (SNP) in genomic region adjacent to shatterproof1 (SHELL) shell thickness gene
acatgacctgatatagcttatgcartgtgtagattgagcagatatactca

SEQ ID NO: 1445 - DNA, 50 bp, Artificial Sequence
  synthetic Elaeis guineensis (oil palm) single nucleotide polymorphism (SNP) in genomic region adjacent to shatterproof1 (SHELL) shell thickness gene
agatatactcaaaatcccaatcgtratcattggactactttagtcagact

SEQ ID NO: 1446 - DNA, 50 bp, Artificial Sequence
  synthetic Elaeis guineensis (oil palm) single nucleotide polymorphism (SNP) in genomic region adjacent to shatterproof1 (SHELL) shell thickness gene
gagatgaatttagccgatcctctgmctaaacctttgggcagaaaattcat

SEQ ID NO: 1447 - DNA, 50 bp, Artificial Sequence
  synthetic Elaeis guineensis (oil palm) single nucleotide polymorphism (SNP) in genomic region adjacent to shatterproof1 (SHELL) shell thickness gene
cccttatgagtggtgtattgaattrcagtgtacacttgatggaatcactt

SEQ ID NO: 1448 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatatatgagtgcgaagtggggtcrcttctgtaagattctttgacaagat

SEQ ID NO: 1449 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgattcatagctcaaaaggcaccartttcgatgcattacactcagttgag

SEQ ID NO: 1450 - DNA, 50 bp, Artificial Sequence
  synthetic Elaeis guineensis (oil palm) single nucleotide polymorphism (SNP) in genomic region adjacent to shatterproof1 (SHELL) shell thickness gene
catagctcaaaaggcaccaatttcratgcattacactcagttgagttaac

SEQ ID NO: 1451 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttttaccaacatcctctcacctaartggcctaaaaatactatcccactta

SEQ ID NO: 1452 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttatattatggcaacaatacttcgycatatttcaaaaacaggtaaaagct

SEQ ID NO: 1453 - DNA, 50 bp, Artificial Sequence
  synthetic Elaeis guineensis (oil palm) single nucleotide polymorphism (SNP) in genomic region adjacent to shatterproof1 (SHELL) shell thickness gene
caatacttcgtcatatttcaaaaayaggtaaaagctatccatctttgaaa

SEQ ID NO: 1454 - DNA, 50 bp, Artificial Sequence
  synthetic Elaeis guineensis (oil palm) single nucleotide polymorphism (SNP) in genomic region adjacent to shatterproof1 (SHELL) shell thickness gene
cagctttctctgattggtccccatrtgccaatcggatgaactcatcatcc

SEQ ID NO: 1455 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttcacctacgttgcctccttttaartggtcggcattcgttttaaacggtc

SEQ ID NO: 1456 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccccaaaaatagctgtttgttgttrtaggttttcttgttcccatgtacaa

SEQ ID NO: 1457 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccggaagcgacttagcttagctacwtaaagattttgaccaatggtgcgta

SEQ ID NO: 1458 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccaatggtgcgtacatcgaaagctkctgtacctataaagtacagctgacc

SEQ ID NO: 1459 - DNA, 50 bp, Artificial Sequence
  synthetic Elaeis guineensis (oil palm) single nucleotide polymorphism (SNP) in genomic region adjacent to shatterproof1 (SHELL) shell thickness gene
gttgattattgcttaaaattgcggytgtgttgtcatcatcttcattatgg

SEQ ID NO: 1460 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttatggaattcatgagaatgttatrggaatgcataattatattcataata

SEQ ID NO: 1461 - DNA, 50 bp, Artificial Sequence
  synthetic Elaeis guineensis (oil palm) single nucleotide polymorphism (SNP) in genomic region adjacent to shatterproof1 (SHELL) shell thickness gene
taactgattttcacatgcaaatatmatgaattatatatagatagctgggg

SEQ ID NO: 1462 - DNA, 50 bp, Artificial Sequence
  synthetic Elaeis guineensis (oil palm) single nucleotide polymorphism (SNP) in genomic region adjacent to shatterproof1 (SHELL) shell thickness gene
catgcaaatatcatgaattatatayagatagctggggaagaaatgaaaga

SEQ ID NO: 1463 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggttctgctaggtatcgggaaaaargggttctcggaatacacccaaattg

SEQ ID NO: 1464 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggtatcgggaaaaaggggttctcgraatacacccaaattgtagaacatgt

SEQ ID NO: 1465 - DNA, 50 bp, Artificial Sequence
  synthetic Elaeis guineensis (oil palm) single nucleotide polymorphism (SNP) in genomic region adjacent to shatterproof1 (SHELL) shell thickness gene
atgtattggttgcaaaatgaaattrtgacatagtcatatgtaaataagct

SEQ ID NO: 1466 - DNA, 50 bp, Artificial Sequence
  synthetic Elaeis guineensis (oil palm) single nucleotide polymorphism (SNP) in genomic region adjacent to shatterproof1 (SHELL) shell thickness gene
taagtcataatttatgcaccaatgrcaaaaaattagggttgaaaattgtg

SEQ ID NO: 1467 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgcataagctagaatatgtatacargcattttatgtgtaacttcaacatt

SEQ ID NO: 1468 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaatatgtatacaggcattttatgwgtaacttcaacattaaaattatttc

SEQ ID NO: 1469 - DNA, 50 bp, Artificial Sequence
  synthetic Elaeis guineensis (oil palm) single nucleotide polymorphism (SNP) in genomic region adjacent to shatterproof1 (SHELL) shell thickness gene
cggcaattttcttagatggttatcwataattagaacctcatttttgcaat

SEQ ID NO: 1470 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagtataaaaataaaattgataacrtatcaataacctgagtttatctata

SEQ ID NO: 1471 - DNA, 50 bp, Artificial Sequence
  synthetic Elaeis guineensis (oil palm) single nucleotide polymorphism (SNP) in genomic region adjacent to shatterproof1 (SHELL) shell thickness gene
attgataacgtatcaataacctgartttatctataccaaatgctaagaat

SEQ ID NO: 1472 - DNA, 50 bp, Artificial Sequence
  synthetic Elaeis guineensis (oil palm) single nucleotide polymorphism (SNP) in genomic region adjacent to shatterproof1 (SHELL) shell thickness gene
atagctcgcaacctttgctaaatcrttcattactcgtaaaaatctagcct

SEQ ID NO: 1473 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttcttgaatattagatttttttcrcattcacatgttccacatcaagaag

SEQ ID NO: 1474 - DNA, 50 bp, Artificial Sequence
  synthetic Elaeis guineensis (oil palm) single nucleotide polymorphism (SNP) in genomic region adjacent to shatterproof1 (SHELL) shell thickness gene
cacattcacatgttccacatcaagraggggattgtggattctctacattc

SEQ ID NO: 1475 - DNA, 50 bp, Artificial Sequence
  synthetic Elaeis guineensis (oil palm) single nucleotide polymorphism (SNP) in genomic region adjacent to shatterproof1 (SHELL) shell thickness gene
aggggattgtggattctctacattsttgtctaaaccggttcctattaaca

SEQ ID NO: 1476 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaccggttcctattaacatcatatrcctttttcaatttactagcataaat

SEQ ID NO: 1477 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttaagcttgcactgtggtcattagktggttggactgccccactcacacgg

SEQ ID NO: 1478 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttagatgctaacgtgcaccaagccmgcagcggcaccacctccacaaatgg

SEQ ID NO: 1479 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggcgatgcgaaccaccgccgctgcracggtcgctgcgccgcctgtcgtgc

SEQ ID NO: 1480 - DNA, 50 bp, Artificial Sequence
  synthetic Elaeis guineensis (oil palm) single nucleotide polymorphism (SNP) in genomic region adjacent to shatterproof1 (SHELL) shell thickness gene
atgcgaaccaccgccgctgcaacgstcgctgcgccgcctgtcgtgccttc

SEQ ID NO: 1481 - DNA, 50 bp, Artificial Sequence
  synthetic Elaeis guineensis (oil palm) single nucleotide polymorphism (SNP) in genomic region adjacent to shatterproof1 (SHELL) shell thickness gene
agcgtccggaggtgttcgtcggccrtgaaggcggtttcgttgcagacacc

SEQ ID NO: 1482 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttcgttgcagacaccggtggcgccygtggaggtgagttggtttttattag

SEQ ID NO: 1483 - DNA, 50 bp, Artificial Sequence
  synthetic Elaeis guineensis (oil palm) single nucleotide polymorphism (SNP) in genomic region adjacent to shatterproof1 (SHELL) shell thickness gene
aattaatattttttgctgcttactwggtaatcctggctcttccttctcga

SEQ ID NO: 1484 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttttttgctgcttactaggtaatcytggctcttccttctcgaaatttatt

SEQ ID NO: 1485 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttctgttggaaaattagaaagaamgaaaaagttcctgtttcattctttt

SEQ ID NO: 1486 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaattagaaagaaagaaaaagttyctgtttcattctttttttacgacaa

SEQ ID NO: 1487 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaaaataaagtgaagtgtcaacarattttggatgatatttgtcaaaaga

SEQ ID NO: 1488 - DNA, 50 bp, Artificial Sequence
  synthetic Elaeis guineensis (oil palm) single nucleotide polymorphism (SNP) in genomic region adjacent to shatterproof1 (SHELL) shell thickness gene
agaactttacacctttcatttctcyactctgcattttcatgtagtacgct

SEQ ID NO: 1489 - DNA, 50 bp, Artificial Sequence
  synthetic Elaeis guineensis (oil palm) single nucleotide polymorphism (SNP) in genomic region adjacent to shatterproof1 (SHELL) shell thickness gene
catttctctactctgcattttcatrtagtacgcttgtaactgcatctagc

SEQ ID NO: 1490 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctactctgcattttcatgtagtackcttgtaactgcatctagcaaaagta

SEQ ID NO: 1491 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagttcatcttttacttgctctatktttctagtagaatcactactattgt

SEQ ID NO: 1492 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcatcttttacttgctctatttttstagtagaatcactactattgtctat

SEQ ID NO: 1493 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaaataatctagtgtacatgcaaygacagaaagacaaggatcttgtatt

SEQ ID NO: 1494 - DNA, 50 bp, Artificial Sequence
  synthetic Elaeis guineensis (oil palm) single nucleotide polymorphism (SNP) in genomic region adjacent to shatterproof1 (SHELL) shell thickness gene
tattggacatttatctgttattgamtgagactgaccaatctttagatgtt

SEQ ID NO: 1495 - DNA, 50 bp, Artificial Sequence
  synthetic Elaeis guineensis (oil palm) single nucleotide polymorphism (SNP) in genomic region adjacent to shatterproof1 (SHELL) shell thickness gene
cttaggacttctgacaagctgtatycctgaattagattgataaatattcc

SEQ ID NO: 1496 - DNA, 50 bp, Artificial Sequence
  synthetic Elaeis guineensis (oil palm) single nucleotide polymorphism (SNP) in genomic region adjacent to shatterproof1 (SHELL) shell thickness gene
tccaagtaagtttggtttagatgtraggtccaagatacccttggatcaag

SEQ ID NO: 1497 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttagatgtaaggtccaagataccmttggatcaaggctgggtaggtctca

SEQ ID NO: 1498 - DNA, 50 bp, Artificial Sequence
  synthetic Elaeis guineensis (oil palm) single nucleotide polymorphism (SNP) in genomic region adjacent to shatterproof1 (SHELL) shell thickness gene
attgtaagttgttcatggtgaccgrcttaaaaacaagattcattgatttg

SEQ ID NO: 1499 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgtaagttgttcatggtgaccgacwtaaaaacaagattcattgatttgtg

SEQ ID NO: 1500 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgaataaagtagtattcttcacctwtatcttggagaaggttgcttaagaa

SEQ ID NO: 1501 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtgatctggctggatttttgctcarctcaactgacttgattgagttataa

SEQ ID NO: 1502 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgacatataatgatgataatatatratacatatattataaaatagtaaat

SEQ ID NO: 1503 - DNA, 50 bp, Artificial Sequence
  synthetic Elaeis guineensis (oil palm) single nucleotide polymorphism (SNP) in genomic region adjacent to shatterproof1 (SHELL) shell thickness gene
gggttacgttttatgaacatttttytttgaaagcttcctgagcattattt

SEQ ID NO: 1504 - DNA, 50 bp, Artificial Sequence
  synthetic Elaeis guineensis (oil palm) single nucleotide polymorphism (SNP) in genomic region adjacent to shatterproof1 (SHELL) shell thickness gene
aacatttttctttgaaagcttcctkagcattatttttactaaattttagc

SEQ ID NO: 1505 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgcacatgcatgcatgtagatgacyctgatttttaagaaaaaataaattt

SEQ ID NO: 1506 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaaaggtagagagcactttatttcrgggcacaagggaaagaaaagagatc

SEQ ID NO: 1507 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttttattatactttttgagaagtgyaatgtatggctgcaggctttgcggc

SEQ ID NO: 1508 - DNA, 50 bp, Artificial Sequence
  synthetic Elaeis guineensis (oil palm) single nucleotide polymorphism (SNP) in genomic region adjacent to shatterproof1 (SHELL) shell thickness gene
cccattggttatgttctcattcttytgagagtgttaagactcactcctac

SEQ ID NO: 1509 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttacttgggatactggttgataatratgtttgcatgtgtgtcttgattat

SEQ ID NO: 1510 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgcttgcagttatgtttgcttgctycccctgctacttgctcctgcactgc

SEQ ID NO: 1511 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgcatgtgttggtgtgcttggagcrctttttaaagttcattctgactctg

SEQ ID NO: 1512 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttaaagttcattctgactctgagtktcaaatttactcctgcaactaagaa

SEQ ID NO: 1513 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaagaaatattttactagaaactakaattcacaatgtgtaacacatccgt

SEQ ID NO: 1514 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagtagatgaatccttctagtagtkgtcaccttgaagttacaaagtattg

SEQ ID NO: 1515 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtcaccttgaagttacaaagtattkcaagccatcaatgataaaaaaatta

SEQ ID NO: 1516 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttggctctaaaatgccacatcaggrcacattctggttgcttaacttatta

SEQ ID NO: 1517 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttaatcttttattgttgccattatmttttttttgttttgttttaagttgt

SEQ ID NO: 1518 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaagaacgttattcttaaatcttgytgttgattggcccagcttcgctttg

SEQ ID NO: 1519 - DNA, 50 bp, Artificial Sequence
  synthetic Elaeis guineensis (oil palm) single nucleotide polymorphism (SNP) in genomic region adjacent to shatterproof1 (SHELL) shell thickness gene
atatctcttgacaatctccccatgyagaacgttgctgctgtgacttcgac

SEQ ID NO: 1520 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcttgacaatctccccatgcagaaygttgctgctgtgacttcgacatcaa

SEQ ID NO: 1521 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaacgttgctgctgtgacttcgacrtcaacacgcactccaatctacaagg

SEQ ID NO: 1522 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttcgacatcaacacgcactccaatmtacaaggcctatgcaaaaggagaaa

SEQ ID NO: 1523 - DNA, 50 bp, Artificial Sequence
  synthetic Elaeis guineensis (oil palm) single nucleotide polymorphism (SNP) in genomic region adjacent to shatterproof1 (SHELL) shell thickness gene
tagtatattaaatgtctaggagtakgaaagggtttacaagacctgatccg

SEQ ID NO: 1524 - DNA, 50 bp, Artificial Sequence
  synthetic Elaeis guineensis (oil palm) single nucleotide polymorphism (SNP) in genomic region adjacent to shatterproof1 (SHELL) shell thickness gene
atattaaatgtctaggagtatgaargggtttacaagacctgatccgagta

SEQ ID NO: 1525 - DNA, 50 bp, Artificial Sequence
  synthetic Elaeis guineensis (oil palm) single nucleotide polymorphism (SNP) in genomic region adjacent to shatterproof1 (SHELL) shell thickness gene
atgaccctagagtcataaaaggatrttataagatttctatggtatttttt

SEQ ID NO: 1526 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggcctctttggctacaactgcaggsataggttgggattggacagctggaa

SEQ ID NO: 1527 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcctatatattggacttctaggaarcacataatcacattgctgtctttca

SEQ ID NO: 1528 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcacaaagtccttccagctttgatrtgccataacaactccatttcaaaag

SEQ ID NO: 1529 - DNA, 50 bp, Artificial Sequence
  synthetic Elaeis guineensis (oil palm) single nucleotide polymorphism (SNP) in genomic region adjacent to shatterproof1 (SHELL) shell thickness gene
tccagattcataaggaggtctcatwggtgaagccccataatgccagtcat

SEQ ID NO: 1530 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagccctttagcatccacgatagartgtgagaggtccctgacagagattc

SEQ ID NO: 1531 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttgatgaattcatcccacatttccmgatattgttgaccattttttcttcc

SEQ ID NO: 1532 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaagaattggccattgaccaaaaamatagagatctgatttggtttctttg

SEQ ID NO: 1533 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttaaaccgatttccacaatattgtkcataaactttagataacttctaaaa

SEQ ID NO: 1534 - DNA, 50 bp, Artificial Sequence
  synthetic Elaeis guineensis (oil palm) single nucleotide polymorphism (SNP) in genomic region adjacent to shatterproof1 (SHELL) shell thickness gene
agctggtgggatgctaattggtatrgtcccacattgtgagcctcaagata

SEQ ID NO: 1535 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttgatatggcatggtacaacacaayacttaatattctgctctagcaatgg

SEQ ID NO: 1536 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggtggctgtacgagcaatgatagayatgttttggatggacccagaagagc

SEQ ID NO: 1537 - DNA, 50 bp, Artificial Sequence
  synthetic Elaeis guineensis (oil palm) single nucleotide polymorphism (SNP) in genomic region adjacent to shatterproof1 (SHELL) shell thickness gene
gatatgttttggatggacccagaakagctatttttgatggtttaattatg

SEQ ID NO: 1538 - DNA, 50 bp, Artificial Sequence
  synthetic Elaeis guineensis (oil palm) single nucleotide polymorphism (SNP) in genomic region adjacent to shatterproof1 (SHELL) shell thickness gene
taaagacatgtattaagacacagtwtcatagcatgattatcctaaaaaat

SEQ ID NO: 1539 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgaaatgtacacaatacaatgaaargataagaagttattatgtaacatag

SEQ ID NO: 1540 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatgtacacaatacaatgaaaggayaagaagttattatgtaacatagtgc

SEQ ID NO: 1541 - DNA, 50 bp, Artificial Sequence
  synthetic Elaeis guineensis (oil palm) single nucleotide polymorphism (SNP) in genomic region adjacent to shatterproof1 (SHELL) shell thickness gene
atatatgactagtaaatcaggtttkagtggcttgtttctttcttggttgt

SEQ ID NO: 1542 - DNA, 50 bp, Artificial Sequence
  synthetic Elaeis guineensis (oil palm) single nucleotide polymorphism (SNP) in genomic region adjacent to shatterproof1 (SHELL) shell thickness gene
agaaaaagagcagttttgaaggctsacaaacaaatttagtttcaggtatc

SEQ ID NO: 1543 - DNA, 50 bp, Artificial Sequence
  synthetic Elaeis guineensis (oil palm) single nucleotide polymorphism (SNP) in genomic region adjacent to shatterproof1 (SHELL) shell thickness gene
cttgatactaggattgtcaaatcaygatttatttacacatcatggcatgc

SEQ ID NO: 1544 - DNA, 50 bp, Artificial Sequence
  synthetic Elaeis guineensis (oil palm) single nucleotide polymorphism (SNP) in genomic region adjacent to shatterproof1 (SHELL) shell thickness gene
tccttgtgcatgccttcaggaaggkgtgccaaccagcttctctatgtgat

SEQ ID NO: 1545 - DNA, 50 bp, Artificial Sequence
  synthetic Elaeis guineensis (oil palm) single nucleotide polymorphism (SNP) in genomic region adjacent to shatterproof1 (SHELL) shell thickness gene
agtaattttgcacagctgcagaagkctaaacttataggtctggtttgagt

SEQ ID NO: 1546 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcttacttctattattctgtatatygtgcaacttacattactgaacattg

SEQ ID NO: 1547 - DNA, 50 bp, Artificial Sequence
  synthetic Elaeis guineensis (oil palm) single nucleotide polymorphism (SNP) in genomic region adjacent to shatterproof1 (SHELL) shell thickness gene
tattctgtatattgtgcaacttacrttactgaacattgtcatccttgaaa

SEQ ID NO: 1548 - DNA, 50 bp, Artificial Sequence
  synthetic Elaeis guineensis (oil palm) single nucleotide polymorphism (SNP) in genomic region adjacent to shatterproof1 (SHELL) shell thickness gene
cccttcaaaggataaaatttatgcrttgcttaaggatcaagcaaagtctg

SEQ ID NO: 1549 - DNA, 50 bp, Artificial Sequence
  synthetic Elaeis guineensis (oil palm) single nucleotide polymorphism (SNP) in genomic region adjacent to shatterproof1 (SHELL) shell thickness gene
acacatacatatatatgcaagtacrtagtaaaaaatagatcacaattaga

SEQ ID NO: 1550 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtaagttttaacattcatgtcagtkaaaatcaaatgaagtaaacttagaa

SEQ ID NO: 1551 - DNA, 50 bp, Artificial Sequence
  synthetic Elaeis guineensis (oil palm) single nucleotide polymorphism (SNP) in genomic region adjacent to shatterproof1 (SHELL) shell thickness gene
agaagtccggaagaggaaattaaawccattatccaaacagaaaaaaggat

SEQ ID NO: 1552 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatttccagtattttattggaaaaractgccatggttttataaattttga

SEQ ID NO: 1553 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttttataaattttgacctttggctrggcaagtgcctttcatcttatagat

SEQ ID NO: 1554 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagagaactggcttttattattatkctcacaaccggctcctttcttgcag

SEQ ID NO: 1555 - DNA, 50 bp, Artificial Sequence
  synthetic Elaeis guineensis (oil palm) single nucleotide polymorphism (SNP) in genomic region adjacent to shatterproof1 (SHELL) shell thickness gene
tggataatgtcagactcattgcttwaccctggacgagctcggctttgtga

SEQ ID NO: 1556 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttactcagacagcagatatggcttytccaaaattattcctaaagttcaca

SEQ ID NO: 1557 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatggcttctccaaaattattcctwaagttcacaccatactgcaacactc

SEQ ID NO: 1558 - DNA, 50 bp, Artificial Sequence
  synthetic Elaeis guineensis (oil palm) single nucleotide polymorphism (SNP) in genomic region adjacent to shatterproof1 (SHELL) shell thickness gene
tggcttctccaaaattattcctaawgttcacaccatactgcaacactcta

SEQ ID NO: 1559 - DNA, 50 bp, Artificial Sequence
  synthetic Elaeis guineensis (oil palm) single nucleotide polymorphism (SNP) in genomic region adjacent to shatterproof1 (SHELL) shell thickness gene
acttttctcttcgttttcttttttmcttttcctttttttcattcaatctg

SEQ ID NO: 1560 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcttttttccttttcctttttttcrttcaatctgtatcatacttcaactt

SEQ ID NO: 1561 - DNA, 50 bp, Artificial Sequence
  synthetic Elaeis guineensis (oil palm) single nucleotide polymorphism (SNP) in genomic region adjacent to shatterproof1 (SHELL) shell thickness gene
cattgagattcatgttgaaatgttyatatccttcatacccatcaaatgac

SEQ ID NO: 1562 - DNA, 50 bp, Artificial Sequence
  synthetic Elaeis guineensis (oil palm) single nucleotide polymorphism (SNP) in genomic region adjacent to shatterproof1 (SHELL) shell thickness gene
atatccttcatacccatcaaatgayagcacattgttatccctcttgacat

SEQ ID NO: 1563 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcagaaatgcagcaacctaggactyatcttctggcatgtggaacctaggg

SEQ ID NO: 1564 - DNA, 50 bp, Artificial Sequence
  synthetic Elaeis guineensis (oil palm) single nucleotide polymorphism (SNP) in genomic region adjacent to shatterproof1 (SHELL) shell thickness gene
atgtggagatgggactcttcaggtmatcttctttgggagtctcttaggcc

SEQ ID NO: 1565 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaatcttggcaaggaaaggctgaarcctgcctaggggtcatattttctac

SEQ ID NO: 1566 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctagctatttgaagagaagataaarcatatgctctcctgcaaagttgccc

SEQ ID NO: 1567 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccaattagagatgcctacaatgcgygaaggaacctaaggatgcgaaaggt

SEQ ID NO: 1568 - DNA, 50 bp, Artificial Sequence
  synthetic Elaeis guineensis (oil palm) single nucleotide polymorphism (SNP) in genomic region adjacent to shatterproof1 (SHELL) shell thickness gene
atgcctacaatgcgcgaaggaaccyaaggatgcgaaaggttgagggctat

SEQ ID NO: 1569 - DNA, 50 bp, Artificial Sequence
  synthetic Elaeis guineensis (oil palm) single nucleotide polymorphism (SNP) in genomic region adjacent to shatterproof1 (SHELL) shell thickness gene
acttgcttttctcttacacatgcgrcttccctcccctatctcaaaaaata

SEQ ID NO: 1570 - DNA, 50 bp, Artificial Sequence
  synthetic Elaeis guineensis (oil palm) single nucleotide polymorphism (SNP) in genomic region adjacent to shatterproof1 (SHELL) shell thickness gene
gacttccctcccctatctcaaaaawtaaaaataaaaataaaaattatccg

SEQ ID NO: 1571 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatccgatttccttaccatgttatkgagtcttgaaaattgattggtcttt

SEQ ID NO: 1572 - DNA, 50 bp, Artificial Sequence
  synthetic Elaeis guineensis (oil palm) single nucleotide polymorphism (SNP) in genomic region adjacent to shatterproof1 (SHELL) shell thickness gene
tggtctttcaataatcgaacaattkctttactttaattatggtttgatag

SEQ ID NO: 1573 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttcaataatcgaacaatttctttrctttaattatggtttgatagaatgg

SEQ ID NO: 1574 - DNA, 50 bp, Artificial Sequence
  synthetic Elaeis guineensis (oil palm) single nucleotide polymorphism (SNP) in genomic region adjacent to shatterproof1 (SHELL) shell thickness gene
taaaccatcacactttggatatagytgataaaacaagaagatatgcagat

SEQ ID NO: 1575 - DNA, 50 bp, Artificial Sequence
  synthetic Elaeis guineensis (oil palm) single nucleotide polymorphism (SNP) in genomic region adjacent to shatterproof1 (SHELL) shell thickness gene
attcaattggttatgttatcaccgraagatccctgcggtcgacactttag

SEQ ID NO: 1576 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggatatcattatatcaatcactctrtagttcctatgatcagagagaaata

SEQ ID NO: 1577 - DNA, 50 bp, Artificial Sequence
  synthetic Elaeis guineensis (oil palm) single nucleotide polymorphism (SNP) in genomic region adjacent to shatterproof1 (SHELL) shell thickness gene
cggtcttccattggcaatggctggraaatattactagctatgatgaacta

SEQ ID NO: 1578 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatgtggacaattaatttatgagaragaaaattcccaattattcttgaga

SEQ ID NO: 1579 - DNA, 50 bp, Artificial Sequence
  synthetic Elaeis guineensis (oil palm) single nucleotide polymorphism (SNP) in genomic region adjacent to shatterproof1 (SHELL) shell thickness gene
gacggcaccaaagttatggtttgcraccccccctcccgtcaagggggagt

SEQ ID NO: 1580 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcaagggggagtatgtgtgcatagrtagaaggcaatcccatggacggcac

SEQ ID NO: 1581 - DNA, 50 bp, Artificial Sequence
  synthetic Elaeis guineensis (oil palm) single nucleotide polymorphism (SNP) in genomic region adjacent to shatterproof1 (SHELL) shell thickness gene
ataaattaataaaatgtgatgcaaytccaaaactgggcaaacacctctca

SEQ ID NO: 1582 - DNA, 50 bp, Artificial Sequence
  synthetic Elaeis guineensis (oil palm) single nucleotide polymorphism (SNP) in genomic region adjacent to shatterproof1 (SHELL) shell thickness gene
aacacctctcatgtgcagaaagccwtcaacttagcttgctctccacataa

SEQ ID NO: 1583 - DNA, 50 bp, Artificial Sequence
  synthetic Elaeis guineensis (oil palm) single nucleotide polymorphism (SNP) in genomic region adjacent to shatterproof1 (SHELL) shell thickness gene
taaaattcatatttctctgttaatkgttagtttcaattaacttgattcca

SEQ ID NO: 1584 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccattcttttcagattccaacattktgttaattcatccacttctgatttt

SEQ ID NO: 1585 - DNA, 50 bp, Artificial Sequence
  synthetic Elaeis guineensis (oil palm) single nucleotide polymorphism (SNP) in genomic region adjacent to shatterproof1 (SHELL) shell thickness gene
atccatggtgacccacaggttccgwtatgccgtgctggcgaaatgcatgc

SEQ ID NO: 1586 - DNA, 50 bp, Artificial Sequence
  synthetic Elaeis guineensis (oil palm) single nucleotide polymorphism (SNP) in genomic region adjacent to shatterproof1 (SHELL) shell thickness gene
cttcccgttaattacttcatcttcstcacaccataatgaagaaaataaaa

SEQ ID NO: 1587 - DNA, 50 bp, Artificial Sequence
  synthetic Elaeis guineensis (oil palm) single nucleotide polymorphism (SNP) in genomic region adjacent to shatterproof1 (SHELL) shell thickness gene
ataattgctaaagaaaagatggcgrtcttcgtcgctagcaatgacatggt

SEQ ID NO: 1588 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgctaaagaaaagatggcggtcttygtcgctagcaatgacatggtggtaa

SEQ ID NO: 1589 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatttgagtattattttttcccatwatcaaagaaaaaacaagcagttctg

SEQ ID NO: 1590 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaagaaaaagcttcataatttctcrgcatttgatcatttaggaagagtct

SEQ ID NO: 1591 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttgatcatttaggaagagtcttggwgaacctaggaaattttggagagatt

SEQ ID NO: 1592 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttctaagaactaaaaaaaaactartgcctccattcatggaatatatgaa

SEQ ID NO: 1593 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgaaatgaaactgaagcctaacctycagtagaatttgaaagagcatcacc

SEQ ID NO: 1594 - DNA, 50 bp, Artificial Sequence
  synthetic Elaeis guineensis (oil palm) single nucleotide polymorphism (SNP) in genomic region adjacent to shatterproof1 (SHELL) shell thickness gene
acagagtccatggaaaagaaaaacscattgcctaaaccacttatgaaagt

SEQ ID NO: 1595 - DNA, 50 bp, Artificial Sequence
  synthetic Elaeis guineensis (oil palm) single nucleotide polymorphism (SNP) in genomic region adjacent to shatterproof1 (SHELL) shell thickness gene
cagaactgctccaccacactctccycctgcctctggagcctccacccaat

SEQ ID NO: 1596 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctacaaacacacacacacacacasagagagagagagagagaacactgca

SEQ ID NO: 1597 - DNA, 50 bp, Artificial Sequence
  synthetic Elaeis guineensis (oil palm) single nucleotide polymorphism (SNP) in genomic region adjacent to shatterproof1 (SHELL) shell thickness gene
atattagattaagaagcatgaaggytcccatggacttttttattcatatt

SEQ ID NO: 1598 - DNA, 50 bp, Artificial Sequence
  synthetic Elaeis guineensis (oil palm) single nucleotide polymorphism (SNP) in genomic region adjacent to shatterproof1 (SHELL) shell thickness gene
gagtaactgagagagaagactagargagatttatgagaaaaactgcatgg

SEQ ID NO: 1599 - DNA, 50 bp, Artificial Sequence
  synthetic Elaeis guineensis (oil palm) single nucleotide polymorphism (SNP) in genomic region adjacent to shatterproof1 (SHELL) shell thickness gene
atttatgagaaaaactgcatggtargcctgaagtaagagctcttctttct

SEQ ID NO: 1600 - DNA, 50 bp, Artificial Sequence
  synthetic Elaeis guineensis (oil palm) single nucleotide polymorphism (SNP) in genomic region adjacent to shatterproof1 (SHELL) shell thickness gene
atcttccaactttggattccatgamaagaagactttagaagagttgacag

SEQ ID NO: 1601 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagactttagaagagttgacagggwaagaggggaataaacaaagaatata

SEQ ID NO: 1602 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaataaacaaagaatatattaagargtggaatgaaattaggatacatata

SEQ ID NO: 1603 - DNA, 50 bp, Artificial Sequence
  synthetic Elaeis guineensis (oil palm) single nucleotide polymorphism (SNP) in genomic region adjacent to shatterproof1 (SHELL) shell thickness gene
atacagagaagattttctttcttaraagagtggatgtttgctttgcttgc

SEQ ID NO: 1604 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcagttacatagatactcaaacttkttaaatttataacttgaaaaagaaa

SEQ ID NO: 1605 - DNA, 50 bp, Artificial Sequence
  synthetic Elaeis guineensis (oil palm) single nucleotide polymorphism (SNP) in genomic region adjacent to shatterproof1 (SHELL) shell thickness gene
atggtagaagttgttatggatcatygtaatgcttataattttatgaataa

SEQ ID NO: 1606 - DNA, 50 bp, Artificial Sequence
  synthetic Elaeis guineensis (oil palm) single nucleotide polymorphism (SNP) in genomic region adjacent to shatterproof1 (SHELL) shell thickness gene
ataacaaataacataattgagttaragatatagatgctgcaataacaata

SEQ ID NO: 1607 - DNA, 50 bp, Artificial Sequence
  synthetic Elaeis guineensis (oil palm) single nucleotide polymorphism (SNP) in genomic region adjacent to shatterproof1 (SHELL) shell thickness gene
ataataacatactgttgaaaatgcycgtgtcttttaaacccccaataaga

SEQ ID NO: 1608 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttttaaacccccaataagaattctrcaaacttctattttggggttaattg

SEQ ID NO: 1609 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaaaaaatttaaataaaaggatgkgtatgccaattaaatttgaaataag

SEQ ID NO: 1610 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggttaatttcaagattcaaagataygtgggtcgcaaccttaaatcatcat

SEQ ID NO: 1611 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatcatcatattctcttttttttamtcactaataattagggtttggatta

SEQ ID NO: 1612 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcatattctcttttttttaatcacyaataattagggtttggattattcat

SEQ ID NO: 1613 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttttttaatcactaataattaggktttggattattcattgatctaacta

SEQ ID NO: 1614 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaataaggttaattattatgatatraaaagaatcatttactattaaggtt

SEQ ID NO: 1615 - DNA, 50 bp, Artificial Sequence
  synthetic Elaeis guineensis (oil palm) single nucleotide polymorphism (SNP) in genomic region adjacent to shatterproof1 (SHELL) shell thickness gene
atactacgacgattcctatgccaakctacaaatattttttctaagctttt

SEQ ID NO: 1616 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttctctcagaatctgcatgacaagratactaccaatgtgcagacatggaa

SEQ ID NO: 1617 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaatgttaggaaagaagcttggagrcaaggtctgaaaatggaggaagagt

SEQ ID NO: 1618 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaatggaggaagagtctgtatcayggtactgtgaagaaattattaaaca

SEQ ID NO: 1619 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaatggaagtcatccattccgattytgattccagacttccactccaccca

SEQ ID NO: 1620 - DNA, 50 bp, Artificial Sequence
  synthetic Elaeis guineensis (oil palm) single nucleotide polymorphism (SNP) in genomic region adjacent to shatterproof1 (SHELL) shell thickness gene
taacttcaatttcctataatttttraagtttccctgactgtgtcgagaaa

SEQ ID NO: 1621 - DNA, 50 bp, Artificial Sequence
  synthetic Elaeis guineensis (oil palm) single nucleotide polymorphism (SNP) in genomic region adjacent to shatterproof1 (SHELL) shell thickness gene
cctataattactttcttttaataartctgggtggcaatccttgcttccct

SEQ ID NO: 1622 - DNA, 50 bp, Artificial Sequence
  synthetic Elaeis guineensis (oil palm) single nucleotide polymorphism (SNP) in genomic region adjacent to shatterproof1 (SHELL) shell thickness gene
tccattaatttgaagtaaagaatcrgtagacgagggcaaccaacaaaagt

SEQ ID NO: 1623 - DNA, 50 bp, Artificial Sequence
  synthetic Elaeis guineensis (oil palm) single nucleotide polymorphism (SNP) in genomic region adjacent to shatterproof1 (SHELL) shell thickness gene
agcatgccatgcaagctggttcaaracttgcaaaaggccttgtcatgcta

SEQ ID NO: 1624 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatcgccatgtctcctcattatgcycattagaccatgagctgccatgata

SEQ ID NO: 1625 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctatggcatgcaatgagtgtgatgrccaaggatctttcaacatagtaaaa

SEQ ID NO: 1626 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaaagattttgtgtactcaaaacasaggctagaactccgaaccaagcaat

SEQ ID NO: 1627 - DNA, 50 bp, Artificial Sequence
  synthetic Elaeis guineensis (oil palm) single nucleotide polymorphism (SNP) in genomic region adjacent to shatterproof1 (SHELL) shell thickness gene
cctttcaaggaataatttgctcatrgtttggaatatagatggctgtaatg

SEQ ID NO: 1628 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaatgcccatcatgttgccattgkcacaacagccaatatttataccatc

SEQ ID NO: 1629 - DNA, 50 bp, Artificial Sequence
  synthetic Elaeis guineensis (oil palm) single nucleotide polymorphism (SNP) in genomic region adjacent to shatterproof1 (SHELL) shell thickness gene
aactcttgagatttagatacatctscttgtatgttattagtgttgattag

SEQ ID NO: 1630 - DNA, 50 bp, Artificial Sequence
  synthetic Elaeis guineensis (oil palm) single nucleotide polymorphism (SNP) in genomic region adjacent to shatterproof1 (SHELL) shell thickness gene
atcggacgtagtggacggagaattmcgcctagccaaagacatcactttac

SEQ ID NO: 1631 - DNA, 50 bp, Artificial Sequence
  synthetic Elaeis guineensis (oil palm) single nucleotide polymorphism (SNP) in genomic region adjacent to shatterproof1 (SHELL) shell thickness gene
atatgcaaataaagattttcgagaycaatatagaaaaatctaaaaattag

SEQ ID NO: 1632 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaagaccgggacaacggtttttctkggtgagcatcgagtgccttgtggtt

SEQ ID NO: 1633 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggcactgcagtgatggccagtagcractcaaagggtgatgctttggagat

SEQ ID NO: 1634 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgatggccagtagcaactcaaaggrtgatgctttggagatatctggtgag

SEQ ID NO: 1635 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttggagatatctggtgaggtatcmacttctttctagcagtggattttag

SEQ ID NO: 1636 - DNA, 50 bp, Artificial Sequence
  synthetic Elaeis guineensis (oil palm) single nucleotide polymorphism (SNP) in genomic region adjacent to shatterproof1 (SHELL) shell thickness gene
catgatggtgcagtgagaaacttgrgggaggtccgatacatatccgattt

SEQ ID NO: 1637 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggtgcagtgagaaacttgggggagrtccgatacatatccgattttagatg

SEQ ID NO: 1638 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttcgagaggctacaggacggtagcyggtggaggaatcttgaaggtgctat

SEQ ID NO: 1639 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgagcccacagcgagatccaggatracgaacgaagtctaaggagcctaag

SEQ ID NO: 1640 - DNA, 50 bp, Artificial Sequence
  synthetic Elaeis guineensis (oil palm) single nucleotide polymorphism (SNP) in genomic region adjacent to shatterproof1 (SHELL) shell thickness gene
cagcgagatccaggataacgaacgragtctaaggagcctaagaacagccc

SEQ ID NO: 1641 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatgcatgaaagaaggatggcacgrtgcattaggcggaggccggtggtgg

SEQ ID NO: 1642 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaggatggcacggtgcattaggcgraggccggtggtggcatcgcgaggcc

SEQ ID NO: 1643 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcgcacgcaggtgcgcgcggcccartgcgtgagcgggcccagtgcaggcg

SEQ ID NO: 1644 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgcacgatcggacagctctggtgcragccgatcacgattgaacggccatg

SEQ ID NO: 1645 - DNA, 50 bp, Artificial Sequence
  synthetic Elaeis guineensis (oil palm) single nucleotide polymorphism (SNP) in genomic region adjacent to shatterproof1 (SHELL) shell thickness gene
gctctggtgcgagccgatcacgatygaacggccatgaatgattctaggct

SEQ ID NO: 1646 - DNA, 50 bp, Artificial Sequence
  synthetic Elaeis guineensis (oil palm) single nucleotide polymorphism (SNP) in genomic region adjacent to shatterproof1 (SHELL) shell thickness gene
acggccatgaatgattctaggcttsattgggattttgttttttagtgtaa

SEQ ID NO: 1647 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctaggcttgattgggattttgtttyttagtgtaacagtgttttagagttt

SEQ ID NO: 1648 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttttattctctcatagtaaagcttrcacgttccatgaagataggctcgag

SEQ ID NO: 1649 - DNA, 50 bp, Artificial Sequence
  synthetic Elaeis guineensis (oil palm) single nucleotide polymorphism (SNP) in genomic region adjacent to shatterproof1 (SHELL) shell thickness gene
atagtaaagcttacacgttccatgragataggctcgaggacaatccacgt

SEQ ID NO: 1650 - DNA, 50 bp, Artificial Sequence
  synthetic Elaeis guineensis (oil palm) single nucleotide polymorphism (SNP) in genomic region adjacent to shatterproof1 (SHELL) shell thickness gene
agataataattattataatattttktttagtattataatgatctgttatg

SEQ ID NO: 1651 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttttgtttagtattataatgatctrttatgacataaataacaatttttat

SEQ ID NO: 1652 - DNA, 50 bp, Artificial Sequence
  synthetic Elaeis guineensis (oil palm) single nucleotide polymorphism (SNP) in genomic region adjacent to shatterproof1 (SHELL) shell thickness gene
atataatttttatccaatgaaaagyatatggaagatttccttaaatggtg

SEQ ID NO: 1653 - DNA, 50 bp, Artificial Sequence
  synthetic Elaeis guineensis (oil palm) single nucleotide polymorphism (SNP) in genomic region adjacent to shatterproof1 (SHELL) shell thickness gene
tacgtccggaatgcgatcatgaatytctatgcccaacatggtcctattga

SEQ ID NO: 1654 - DNA, 50 bp, Artificial Sequence
  synthetic Elaeis guineensis (oil palm) single nucleotide polymorphism (SNP) in genomic region adjacent to shatterproof1 (SHELL) shell thickness gene
acagtggattctggcgatcgagctytttaaagagatggcgattgcgaagg

SEQ ID NO: 1655 - DNA, 50 bp, Artificial Sequence
  synthetic Elaeis guineensis (oil palm) single nucleotide polymorphism (SNP) in genomic region adjacent to shatterproof1 (SHELL) shell thickness gene
agcagtcggtggagaatcgccgccrccgccgccggacatgcaagcagctc

SEQ ID NO: 1656 - DNA, 50 bp, Artificial Sequence
  synthetic Elaeis guineensis (oil palm) single nucleotide polymorphism (SNP) in genomic region adjacent to shatterproof1 (SHELL) shell thickness gene
caagcagctcataaggctctcatcracaaagtctgagcggccctccgaca

SEQ ID NO: 1657 - DNA, 50 bp, Artificial Sequence
  synthetic Elaeis guineensis (oil palm) single nucleotide polymorphism (SNP) in genomic region adjacent to shatterproof1 (SHELL) shell thickness gene
cataaggctctcatcgacaaagtcygagcggccctccgacaatccttggt

SEQ ID NO: 1658 - DNA, 50 bp, Artificial Sequence
  synthetic Elaeis guineensis (oil palm) single nucleotide polymorphism (SNP) in genomic region adjacent to shatterproof1 (SHELL) shell thickness gene
tggtgatgggcggaggtggggttcrtgccagccccacggacgctcgccat

SEQ ID NO: 1659 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccatgtccaatttttgctttgtatkgagtctacaaaaatcttaaagtaga

SEQ ID NO: 1660 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttctgcagtgcatggacaacaccrctgggaatcctctttgaagtatgcg

SEQ ID NO: 1661 - DNA, 50 bp, Artificial Sequence
  synthetic Elaeis guineensis (oil palm) single nucleotide polymorphism (SNP) in genomic region adjacent to shatterproof1 (SHELL) shell thickness gene
taacagttgtcaatacgtgttgatyaggcaatcccatccatccaaggttt

SEQ ID NO: 1662 - DNA, 50 bp, Artificial Sequence
  synthetic Elaeis guineensis (oil palm) single nucleotide polymorphism (SNP) in genomic region adjacent to shatterproof1 (SHELL) shell thickness gene
catccatccaaggtttcacgaagckcctgaaaatgaatatcgcgtattac

SEQ ID NO: 1663 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgcctgccgtgactgctgggaagcraagatgaggcggtaggggcagcaaa

SEQ ID NO: 1664 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtcagacgagaaagaagaaaacaasacattcaatataaggaactcatata

SEQ ID NO: 1665 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaggaaaaacagaaagcagcaaaaraaagaaatggggaaaaggctatgca

SEQ ID NO: 1666 - DNA, 50 bp, Artificial Sequence
  synthetic Elaeis guineensis (oil palm) single nucleotide polymorphism (SNP) in genomic region adjacent to shatterproof1 (SHELL) shell thickness gene
atatgattatttaagacaagaaagraataatcctgggaaatcattgagca

SEQ ID NO: 1667 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttcattaacctgtataagattgtcratcgaataaatccacatcctcagat

SEQ ID NO: 1668 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgcatctcatcactagtagcatcargggaagagggttgatgactgtgcgg

SEQ ID NO: 1669 - DNA, 50 bp, Artificial Sequence
  synthetic Elaeis guineensis (oil palm) single nucleotide polymorphism (SNP) in genomic region adjacent to shatterproof1 (SHELL) shell thickness gene
agtgggggcgttggggtgtcgtacmgcccaagaaaaaagaaatctaaaca

SEQ ID NO: 1670 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatgactctactgttagatgtatgycctaaaagccagattggttgaaaca

SEQ ID NO: 1671 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttagtggttaatttctaaatgctcycgttcgatagaacgtcatggggacg

SEQ ID NO: 1672 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaagtccaggtgcttaatagagatyaagagtactgagcgtgaccaacacg

SEQ ID NO: 1673 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtcggtgacttgctcaaagttgcartggtgtagatagttctttaacctgc

SEQ ID NO: 1674 - DNA, 50 bp, Artificial Sequence
  synthetic Elaeis guineensis (oil palm) single nucleotide polymorphism (SNP) in genomic region adjacent to shatterproof1 (SHELL) shell thickness gene
agttctttaacctgcgatgcctcarctgcttacagcaaggttgctatagt

SEQ ID NO: 1675 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctgcgatgcctcagctgcttacagyaaggttgctatagtttgactgcata

SEQ ID NO: 1676 - DNA, 50 bp, Artificial Sequence
  synthetic Elaeis guineensis (oil palm) single nucleotide polymorphism (SNP) in genomic region adjacent to shatterproof1 (SHELL) shell thickness gene
cttctagccatttggagccttgagrtgtatgttggctacagtagatccat

SEQ ID NO: 1677 - DNA, 50 bp, Artificial Sequence
  synthetic Elaeis guineensis (oil palm) single nucleotide polymorphism (SNP) in genomic region adjacent to shatterproof1 (SHELL) shell thickness gene
aggaataggatgagcatcaaaatgraatttgtcgaccccgatagatagag

SEQ ID NO: 1678 - DNA, 50 bp, Artificial Sequence
  synthetic Elaeis guineensis (oil palm) single nucleotide polymorphism (SNP) in genomic region adjacent to shatterproof1 (SHELL) shell thickness gene
taaaactgagtcctaaaatccatgrtcatggtagatgaatgatgaaaaaa

SEQ ID NO: 1679 - DNA, 50 bp, Artificial Sequence
  synthetic Elaeis guineensis (oil palm) single nucleotide polymorphism (SNP) in genomic region adjacent to shatterproof1 (SHELL) shell thickness gene
caatccttcgaaaagagtttccatratattgttgatagagatcacaatat

SEQ ID NO: 1680 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttccatgatattgttgatagagatyacaatatatcttactatcggatgga

SEQ ID NO: 1681 - DNA, 50 bp, Artificial Sequence
  synthetic Elaeis guineensis (oil palm) single nucleotide polymorphism (SNP) in genomic region adjacent to shatterproof1 (SHELL) shell thickness gene
gggtttaagaaaaccctgctagcayatggttaaacccattttttcctact

SEQ ID NO: 1682 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccaaattgaagcaagctcatttagracaccaagagttggagtccttaaag

SEQ ID NO: 1683 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttcttcgactagataagaggcacaygccggcatggataagatccatgtgt

SEQ ID NO: 1684 - DNA, 50 bp, Artificial Sequence
  synthetic Elaeis guineensis (oil palm) single nucleotide polymorphism (SNP) in genomic region adjacent to shatterproof1 (SHELL) shell thickness gene
atcgaaaacggagagagtatcctartccgaatccaaacggatacctgtag

SEQ ID NO: 1685 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctcatttaaaattgttttaaatttytgattttcttaatctagatgcatga

SEQ ID NO: 1686 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctgatcttgatcggatcgcatgtcrgatcgaaaaatttttgaattccact

SEQ ID NO: 1687 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctgatatcagagccaggttgtacaratcatgcatcttaaattaagatcag

SEQ ID NO: 1688 - DNA, 50 bp, Artificial Sequence
  synthetic Elaeis guineensis (oil palm) single nucleotide polymorphism (SNP) in genomic region adjacent to shatterproof1 (SHELL) shell thickness gene
cttattaggactgatttttatgctkaatctaaaggttatgattaaatctg

SEQ ID NO: 1689 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcttaacataagtgttatgttgcaygaggtgtattttgcaaaggatcatg

SEQ ID NO: 1690 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgtattttgcaaaggatcatgtctrgatctattttgcatgagatgtaatt

SEQ ID NO: 1691 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccctagatccaaaaaccctaggatytgtttgtatatgttgcatttaagtt

SEQ ID NO: 1692 - DNA, 50 bp, Artificial Sequence
  synthetic Elaeis guineensis (oil palm) single nucleotide polymorphism (SNP) in genomic region adjacent to shatterproof1 (SHELL) shell thickness gene
atgagtcgactcagttgtgcagacwgaggcttacaggatttctgttcgtc

SEQ ID NO: 1693 - DNA, 50 bp, Artificial Sequence
  synthetic Elaeis guineensis (oil palm) single nucleotide polymorphism (SNP) in genomic region adjacent to shatterproof1 (SHELL) shell thickness gene
agtctcgattgtgatttttaattgrgatcatgcttacctggccatgcata

SEQ ID NO: 1694 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctcttccatgttgactgttctggaytggatacagtgattcagttgcatca

SEQ ID NO: 1695 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagatagggttggacctaagatctrtcagatgaagatccaatgacggttt

SEQ ID NO: 1696 - DNA, 50 bp, Artificial Sequence
  synthetic Elaeis guineensis (oil palm) single nucleotide polymorphism (SNP) in genomic region adjacent to shatterproof1 (SHELL) shell thickness gene
gttggacctaagatctgtcagatgwagatccaatgacggtttcactcgcg

SEQ ID NO: 1697 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgcaatttacttgagaagcattggrcaagagttgaccacccattggttga

SEQ ID NO: 1698 - DNA, 50 bp, Artificial Sequence
  synthetic Elaeis guineensis (oil palm) single nucleotide polymorphism (SNP) in genomic region adjacent to shatterproof1 (SHELL) shell thickness gene
cattggttgacatattcaccaagayctgtcaggtgaggtggtgtgccaat

SEQ ID NO: 1699 - DNA, 50 bp, Artificial Sequence
  synthetic Elaeis guineensis (oil palm) single nucleotide polymorphism (SNP) in genomic region adjacent to shatterproof1 (SHELL) shell thickness gene
gggagctccgcagaaataatgagarctaagtttgtttctaaaataaattc

SEQ ID NO: 1700 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcagaaataatgagaactaagtttrtttctaaaataaattctctagaata

SEQ ID NO: 1701 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaatttcctctctgtagaattttktctccttctaatagtctagcctgca

SEQ ID NO: 1702 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttgtctccttctaatagtctagccygcatcttaaaaatcaaccaattgtc

SEQ ID NO: 1703 - DNA, 50 bp, Artificial Sequence
  synthetic Elaeis guineensis (oil palm) single nucleotide polymorphism (SNP) in genomic region adjacent to shatterproof1 (SHELL) shell thickness gene
gattggctaagggacttgaaaagcrttttgagttccaagaagctagatta

SEQ ID NO: 1704 - DNA, 50 bp, Artificial Sequence
  synthetic Elaeis guineensis (oil palm) single nucleotide polymorphism (SNP) in genomic region adjacent to shatterproof1 (SHELL) shell thickness gene
tccaagaagctagattatgtcttaraccaaaaatgtttattgggaccatg

SEQ ID NO: 1705 - DNA, 50 bp, Artificial Sequence
  synthetic Elaeis guineensis (oil palm) single nucleotide polymorphism (SNP) in genomic region adjacent to shatterproof1 (SHELL) shell thickness gene
attgggaccatgaagtgttcaaaaracacctttagaaggtatgtcggact

SEQ ID NO: 1706 - DNA, 50 bp, Artificial Sequence
  synthetic Elaeis guineensis (oil palm) single nucleotide polymorphism (SNP) in genomic region adjacent to shatterproof1 (SHELL) shell thickness gene
taagcaacagagcaaagattactgytgttgtcgtagggacctatcttctt

SEQ ID NO: 1707 - DNA, 50 bp, Artificial Sequence
  synthetic Elaeis guineensis (oil palm) single nucleotide polymorphism (SNP) in genomic region adjacent to shatterproof1 (SHELL) shell thickness gene
gttactgtgtacctaatacaagcaraaatttgatttttatttcatactta

SEQ ID NO: 1708 - DNA, 50 bp, Artificial Sequence
  synthetic Elaeis guineensis (oil palm) single nucleotide polymorphism (SNP) in genomic region adjacent to shatterproof1 (SHELL) shell thickness gene
tggtcacttaatcaacagtttctaycatttgcatgttgctgcagatgaat

SEQ ID NO: 1709 - DNA, 50 bp, Artificial Sequence
  synthetic Elaeis guineensis (oil palm) single nucleotide polymorphism (SNP) in genomic region adjacent to shatterproof1 (SHELL) shell thickness gene
tactaggtctggtacatagtgatayatgcggcctatttgatgtgccggcc

SEQ ID NO: 1710 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaattcagatttaaggtagagaagyaaactgagaaatcacttaaggtact

SEQ ID NO: 1711 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttaaggtacttcgatcagatcgagrgaaatacctaagtgaaaaatttctc

SEQ ID NO: 1712 - DNA, 50 bp, Artificial Sequence
  synthetic Elaeis guineensis (oil palm) single nucleotide polymorphism (SNP) in genomic region adjacent to shatterproof1 (SHELL) shell thickness gene
acgcctcagctcaacgggatttcaraacagagaaatcagaccctattaaa

SEQ ID NO: 1713 - DNA, 50 bp, Artificial Sequence
  synthetic Elaeis guineensis (oil palm) single nucleotide polymorphism (SNP) in genomic region adjacent to shatterproof1 (SHELL) shell thickness gene
atccattcctaccacaccatatgaratgtcgcatggtaagaagccgaatt

SEQ ID NO: 1714 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttcctaccacaccatatgagatgtygcatggtaagaagccgaattttggt

SEQ ID NO: 1715 - DNA, 50 bp, Artificial Sequence
  synthetic Elaeis guineensis (oil palm) single nucleotide polymorphism (SNP) in genomic region adjacent to shatterproof1 (SHELL) shell thickness gene
aattagagactaggtctatgagagmtcgttttgtaggatacctgaaaaaa

SEQ ID NO: 1716 - DNA, 50 bp, Artificial Sequence
  synthetic Elaeis guineensis (oil palm) single nucleotide polymorphism (SNP) in genomic region adjacent to shatterproof1 (SHELL) shell thickness gene
agaaaatgttcctcataggtgataygaaccatgctgatgatcctaaatct

SEQ ID NO: 1717 - DNA, 50 bp, Artificial Sequence
  synthetic Elaeis guineensis (oil palm) single nucleotide polymorphism (SNP) in genomic region adjacent to shatterproof1 (SHELL) shell thickness gene
cctcataggtgatatgaaccatgcygatgatcctaaatctatgacgagac

SEQ ID NO: 1718 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctttcacagcaactgtacatagaraaagtgctgaagcggttcagcatgg

SEQ ID NO: 1719 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctgtacatagagaaagtgctgaagyggttcagcatggagaatttcaagag

SEQ ID NO: 1720 - DNA, 50 bp, Artificial Sequence
  synthetic Elaeis guineensis (oil palm) single nucleotide polymorphism (SNP) in genomic region adjacent to shatterproof1 (SHELL) shell thickness gene
agtcgaatccagatgaggagcattrgattgctgtgaagaatatccttaaa

SEQ ID NO: 1721 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaagtctacatcatgttttgtattyctgtgtaacgatggtgcagttagct

SEQ ID NO: 1722 - DNA, 50 bp, Artificial Sequence
  synthetic Elaeis guineensis (oil palm) single nucleotide polymorphism (SNP) in genomic region adjacent to shatterproof1 (SHELL) shell thickness gene
atcgccgcgttggaggctgctaagraaaaattctggttcaaaaaatttat

SEQ ID NO: 1723 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaaaattctggttcaaaaaatttrttgcagagctggatgtgatgccacc

SEQ ID NO: 1724 - DNA, 50 bp, Artificial Sequence
  synthetic Elaeis guineensis (oil palm) single nucleotide polymorphism (SNP) in genomic region adjacent to shatterproof1 (SHELL) shell thickness gene
gttcaaaaaatttattgcagagctkgatgtgatgccaccagatgccattc

SEQ ID NO: 1725 - DNA, 50 bp, Artificial Sequence
  synthetic Elaeis guineensis (oil palm) single nucleotide polymorphism (SNP) in genomic region adjacent to shatterproof1 (SHELL) shell thickness gene
attccactctgctacaacaacaatratgccataacactcactaagaaact

SEQ ID NO: 1726 - DNA, 50 bp, Artificial Sequence
  synthetic Elaeis guineensis (oil palm) single nucleotide polymorphism (SNP) in genomic region adjacent to shatterproof1 (SHELL) shell thickness gene
gagaagatgaggcttaagttcatgrtcaatagactttagaccaagtgaga

SEQ ID NO: 1727 - DNA, 50 bp, Artificial Sequence
  synthetic Elaeis guineensis (oil palm) single nucleotide polymorphism (SNP) in genomic region adjacent to shatterproof1 (SHELL) shell thickness gene
atgaggcttaagttcatggtcaatwgactttagaccaagtgagagtttat

SEQ ID NO: 1728 - DNA, 50 bp, Artificial Sequence
  synthetic Elaeis guineensis (oil palm) single nucleotide polymorphism (SNP) in genomic region adjacent to shatterproof1 (SHELL) shell thickness gene
taaattatccataaatcgttcgaaraattaacggatgatgacacgtattt

SEQ ID NO: 1729 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcgacagtgtggagacactgaagcraaagtgtaggtgcttgatagagatc

SEQ ID NO: 1730 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtgtaaatagttctttgacttgcgrtgcctcggttgttcacagtaggatt

SEQ ID NO: 1731 - DNA, 50 bp, Artificial Sequence
  synthetic Elaeis guineensis (oil palm) single nucleotide polymorphism (SNP) in genomic region adjacent to shatterproof1 (SHELL) shell thickness gene
gagatcctatatagtttatgaaacrgagtcctaaaatccatgatcatggt

SEQ ID NO: 1732 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctgatggattgccactacatactgytaggtgtcactgatggatcataaga

SEQ ID NO: 1733 - DNA, 50 bp, Artificial Sequence
  synthetic Elaeis guineensis (oil palm) single nucleotide polymorphism (SNP) in genomic region adjacent to shatterproof1 (SHELL) shell thickness gene
gataagaatgaggaggttacatctraattcaaatttgaatttgaatttgg

SEQ ID NO: 1734 - DNA, 50 bp, Artificial Sequence
  synthetic Elaeis guineensis (oil palm) single nucleotide polymorphism (SNP) in genomic region adjacent to shatterproof1 (SHELL) shell thickness gene
agttgggcgacaactaccctatccktggtgtacaccaatctgaatttctc

SEQ ID NO: 1735 - DNA, 50 bp, Artificial Sequence
  synthetic Elaeis guineensis (oil palm) single nucleotide polymorphism (SNP) in genomic region adjacent to shatterproof1 (SHELL) shell thickness gene
agagccctccaatcatatccacgcmtgttctccctcttctctctgatctc

SEQ ID NO: 1736 - DNA, 50 bp, Artificial Sequence
  synthetic Elaeis guineensis (oil palm) single nucleotide polymorphism (SNP) in genomic region adjacent to shatterproof1 (SHELL) shell thickness gene
cggctcaacagcgaacctcaaatcyacgatcatcggattgcggagttcat

SEQ ID NO: 1737 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccattgtagccgaaagaaaagatgrtgcattagtccagtcaggaacaata

SEQ ID NO: 1738 - DNA, 50 bp, Artificial Sequence
  synthetic Elaeis guineensis (oil palm) single nucleotide polymorphism (SNP) in genomic region adjacent to shatterproof1 (SHELL) shell thickness gene
caagcaattactgatcatcgattgyagtccatgagcaaatattccctctt

SEQ ID NO: 1739 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaattgacaatacagactatacacytaaataactaactaaacaatcccaa

SEQ ID NO: 1740 - DNA, 50 bp, Artificial Sequence
  synthetic Elaeis guineensis (oil palm) single nucleotide polymorphism (SNP) in genomic region adjacent to shatterproof1 (SHELL) shell thickness gene
atcagttaaagacaataaaaagaayaaagcattagtaaaaatagcattct

SEQ ID NO: 1741 - DNA, 50 bp, Artificial Sequence
  synthetic Elaeis guineensis (oil palm) single nucleotide polymorphism (SNP) in genomic region adjacent to shatterproof1 (SHELL) shell thickness gene
atactaaccatatcatgaagataamaaattttcttcctgacaaacattta

SEQ ID NO: 1742 - DNA, 50 bp, Artificial Sequence
  synthetic Elaeis guineensis (oil palm) single nucleotide polymorphism (SNP) in genomic region adjacent to shatterproof1 (SHELL) shell thickness gene
aattaagtcagacttgttcaaggaraacagtcctttttaacttctttaca

SEQ ID NO: 1743 - DNA, 50 bp, Artificial Sequence
  synthetic Elaeis guineensis (oil palm) single nucleotide polymorphism (SNP) in genomic region adjacent to shatterproof1 (SHELL) shell thickness gene
cctttcgataataaggactaagatrgagtttaaaatttcgcaagaaatgt

SEQ ID NO: 1744 - DNA, 50 bp, Artificial Sequence
  synthetic Elaeis guineensis (oil palm) single nucleotide polymorphism (SNP) in genomic region adjacent to shatterproof1 (SHELL) shell thickness gene
tggtaaaaatgaaaagaaaaaaccyaataagctaagtaccagctacaaga

SEQ ID NO: 1745 - DNA, 50 bp, Artificial Sequence
  synthetic Elaeis guineensis (oil palm) single nucleotide polymorphism (SNP) in genomic region adjacent to shatterproof1 (SHELL) shell thickness gene
cagggttttaaatcccgtgggacarggcagttccaattttttcatggaac

SEQ ID NO: 1746 - DNA, 50 bp, Artificial Sequence
  synthetic Elaeis guineensis (oil palm) single nucleotide polymorphism (SNP) in genomic region adjacent to shatterproof1 (SHELL) shell thickness gene
cggaatgcactgccgtcctgtcccrtcccaatacttgggatagaggacgt

SEQ ID NO: 1747 - DNA, 50 bp, Artificial Sequence
  synthetic Elaeis guineensis (oil palm) single nucleotide polymorphism (SNP) in genomic region adjacent to shatterproof1 (SHELL) shell thickness gene
cactgccgtcctgtcccgtcccaayacttgggatagaggacgtcccaatc

SEQ ID NO: 1748 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgggacggtcctgtcccaacacatrggatggtaccccatccaagtgtccc

SEQ ID NO: 1749 - DNA, 50 bp, Artificial Sequence
  synthetic Elaeis guineensis (oil palm) single nucleotide polymorphism (SNP) in genomic region adjacent to shatterproof1 (SHELL) shell thickness gene
catctgaaattttggacattcatgrtcaacaatgtggatgattgatttca

SEQ ID NO: 1750 - DNA, 50 bp, Artificial Sequence
  synthetic Elaeis guineensis (oil palm) single nucleotide polymorphism (SNP) in genomic region adjacent to shatterproof1 (SHELL) shell thickness gene
atctaaaggggccgaaacaacaaawtttgatctttcagcgtcagatcatc

SEQ ID NO: 1751 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgagaaaacaaagaaatcaaaagargacctgttaaaggaggtgaaaatgt

SEQ ID NO: 1752 - DNA, 50 bp, Artificial Sequence
  synthetic Elaeis guineensis (oil palm) single nucleotide polymorphism (SNP) in genomic region adjacent to shatterproof1 (SHELL) shell thickness gene
acataaaaaacatttttttcagaamccagccacaacacaaacaaaccaaa

SEQ ID NO: 1753 - DNA, 50 bp, Artificial Sequence
  synthetic Elaeis guineensis (oil palm) single nucleotide polymorphism (SNP) in genomic region adjacent to shatterproof1 (SHELL) shell thickness gene
gagcgagagagcaataaattagggytcccaatctctgtcgagagattagg

SEQ ID NO: 1754 - DNA, 50 bp, Artificial Sequence
  synthetic Elaeis guineensis (oil palm) single nucleotide polymorphism (SNP) in genomic region adjacent to shatterproof1 (SHELL) shell thickness gene
agccatgtaactttattcagtgatktgtgtgttttatctaatatttttga

SEQ ID NO: 1755 - DNA, 50 bp, Artificial Sequence
  synthetic Elaeis guineensis (oil palm) single nucleotide polymorphism (SNP) in genomic region adjacent to shatterproof1 (SHELL) shell thickness gene
caacaaaaaaataacgagagatttrttgtgtgactaatgcctccacattt

SEQ ID NO: 1756 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgtgtgactaatgcctccacatttytattgatagtcttgattatttattt

SEQ ID NO: 1757 - DNA, 50 bp, Artificial Sequence
  synthetic Elaeis guineensis (oil palm) single nucleotide polymorphism (SNP) in genomic region adjacent to shatterproof1 (SHELL) shell thickness gene
attattttgaaacttttagttttaygttgccaacaatttgccctctatat

SEQ ID NO: 1758 - DNA, 50 bp, Artificial Sequence
  synthetic Elaeis guineensis (oil palm) single nucleotide polymorphism (SNP) in genomic region adjacent to shatterproof1 (SHELL) shell thickness gene
caatttgccctctatatctactacygtgtcaatcatattatatatattct

SEQ ID NO: 1759 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaaaaattaatatatttaacaatrtatatattatatcatgatagtatat

SEQ ID NO: 1760 - DNA, 50 bp, Artificial Sequence
  synthetic Elaeis guineensis (oil palm) single nucleotide polymorphism (SNP) in genomic region adjacent to shatterproof1 (SHELL) shell thickness gene
aattattagacatgcataaatacayaagcaaaaaatctcatgtacatatt

SEQ ID NO: 1761 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtctgtttcctctttctcattgccytcatcccctcgctccagtggcgtaa

SEQ ID NO: 1762 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttctttggggtacaataaacgaacrttaaaaaataggtggactttgcgtt

SEQ ID NO: 1763 - DNA, 50 bp, Artificial Sequence
  synthetic Elaeis guineensis (oil palm) single nucleotide polymorphism (SNP) in genomic region adjacent to shatterproof1 (SHELL) shell thickness gene
tggaatacttggctgtccccgtcckctgtccgtaaataatcattgctgaa

SEQ ID NO: 1764 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttttccaaatcggatcctatttttycattaataacaaacccttggagaga

SEQ ID NO: 1765 - DNA, 50 bp, Artificial Sequence
  synthetic Elaeis guineensis (oil palm) single nucleotide polymorphism (SNP) in genomic region adjacent to shatterproof1 (SHELL) shell thickness gene
caaatcggatcctattttttcattmataacaaacccttggagagagaaaa

SEQ ID NO: 1766 - DNA, 50 bp, Artificial Sequence
  synthetic Elaeis guineensis (oil palm) single nucleotide polymorphism (SNP) in genomic region adjacent to shatterproof1 (SHELL) shell thickness gene
attaataacaaacccttggagagaraaaaaatgcgaagaggtagaattta

SEQ ID NO: 1767 - DNA, 50 bp, Artificial Sequence
  synthetic Elaeis guineensis (oil palm) single nucleotide polymorphism (SNP) in genomic region adjacent to shatterproof1 (SHELL) shell thickness gene
tccttttggccaactaagtatgatsctgctactaattggcagtttctgca

SEQ ID NO: 1768 - DNA, 50 bp, Artificial Sequence
  synthetic Elaeis guineensis (oil palm) single nucleotide polymorphism (SNP) in genomic region adjacent to shatterproof1 (SHELL) shell thickness gene
atagaggcacttgattttttatttygagggggagagagaaggttcaacgt

SEQ ID NO: 1769 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctatggaaacatctagtggatgttytttacttgttgcttgttggtatttc

SEQ ID NO: 1770 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttgttggtatttcattgtgattgcwtgcatgtatcttttgttcaaggaat

SEQ ID NO: 1771 - DNA, 50 bp, Artificial Sequence
  synthetic Elaeis guineensis (oil palm) single nucleotide polymorphism (SNP) in genomic region adjacent to shatterproof1 (SHELL) shell thickness gene
atgaagttaactggttaaaatgcasaggtccaagaggaaattaatgaact

SEQ ID NO: 1772 - DNA, 50 bp, Artificial Sequence
  synthetic Elaeis guineensis (oil palm) single nucleotide polymorphism (SNP) in genomic region adjacent to shatterproof1 (SHELL) shell thickness gene
taagcatccaactctggttctcttwtatgttctgctattgggagttgcaa

SEQ ID NO: 1773 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatctgtttcctagggtaagggccytttttatgattctattgaagcagta

SEQ ID NO: 1774 - DNA, 50 bp, Artificial Sequence
  synthetic Elaeis guineensis (oil palm) single nucleotide polymorphism (SNP) in genomic region adjacent to shatterproof1 (SHELL) shell thickness gene
cttgccaaaaatattattctcatarcctgtatgttaatagaattcttttc

SEQ ID NO: 1775 - DNA, 50 bp, Artificial Sequence
  synthetic Elaeis guineensis (oil palm) single nucleotide polymorphism (SNP) in genomic region adjacent to shatterproof1 (SHELL) shell thickness gene
atctgttgtttcgatgactgagtcratttctttcatggcatccatatacg

SEQ ID NO: 1776 - DNA, 50 bp, Artificial Sequence
  synthetic Elaeis guineensis (oil palm) single nucleotide polymorphism (SNP) in genomic region adjacent to shatterproof1 (SHELL) shell thickness gene
caacatcattcccatgcagcaaacycagggagcttaaagatagactacat

SEQ ID NO: 1777 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaaatcatggtgcacaatttctacraacatataataaagctgttgaaaag

SEQ ID NO: 1778 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgacatcaactggtgtattttgccrggtgaatgtgcaggaaccaatttaa

SEQ ID NO: 1779 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctgtcctttgagccaatcaaacttrtacagtggaatacatgtcaagtctc

SEQ ID NO: 1780 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtaaaatcggttaagttagttacgratttgcatgcagatatggaggtatc

SEQ ID NO: 1781 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgtatatttttttataagttgctgraaaaggtccatatattgatctcttt

SEQ ID NO: 1782 - DNA, 50 bp, Artificial Sequence
  synthetic Elaeis guineensis (oil palm) single nucleotide polymorphism (SNP) in genomic region adjacent to shatterproof1 (SHELL) shell thickness gene
cgcacaagctgatacaccatcagargtgagccaacttcttattttactca

SEQ ID NO: 1783 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaggctcaaggaacgtaaggcagamaagccattgtaaagcctctgataat

SEQ ID NO: 1784 - DNA, 50 bp, Artificial Sequence
  synthetic Elaeis guineensis (oil palm) single nucleotide polymorphism (SNP) in genomic region adjacent to shatterproof1 (SHELL) shell thickness gene
atcaacacttttctttgtcctttgytacttttaatattaacaaaacataa

SEQ ID NO: 1785 - DNA, 50 bp, Artificial Sequence
  synthetic Elaeis guineensis (oil palm) single nucleotide polymorphism (SNP) in genomic region adjacent to shatterproof1 (SHELL) shell thickness gene
acttaggacccatgccaatcctccmgataatatttttcagacaaggtttt

SEQ ID NO: 1786 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcctacatctattgtgatcctcacraaattgatgagaatggaccagaaac

SEQ ID NO: 1787 - DNA, 50 bp, Artificial Sequence
  synthetic Elaeis guineensis (oil palm) single nucleotide polymorphism (SNP) in genomic region adjacent to shatterproof1 (SHELL) shell thickness gene
acatcaatataggtggttttttttwaaaaaaaaaagaattcatatttttg

SEQ ID NO: 1788 - DNA, 50 bp, Artificial Sequence
  synthetic Elaeis guineensis (oil palm) single nucleotide polymorphism (SNP) in genomic region adjacent to shatterproof1 (SHELL) shell thickness gene
aattcatatttttgtttgtaaaatrcaatttcaatggcatttcattcata

SEQ ID NO: 1789 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctcctaagatttcaagggaaaacartggggaagaaacacacactagagtg

SEQ ID NO: 1790 - DNA, 50 bp, Artificial Sequence
  synthetic Elaeis guineensis (oil palm) single nucleotide polymorphism (SNP) in genomic region adjacent to shatterproof1 (SHELL) shell thickness gene
agtcaagaggagtcaacggtcaacygtcgcggtcaaagtcaaagtttccg

SEQ ID NO: 1791 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgtaaaaatattattgtaccatttyttttgttcttgagcaggtaaatatt

SEQ ID NO: 1792 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttgtgatgtcatttggaaggttaawgactagagttatttgagttataata

SEQ ID NO: 1793 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttgagttataataagatcaggaaycctatattagcaaggagaagaaaag

SEQ ID NO: 1794 - DNA, 50 bp, Artificial Sequence
  synthetic Elaeis guineensis (oil palm) single nucleotide polymorphism (SNP) in genomic region adjacent to shatterproof1 (SHELL) shell thickness gene
cgaggattctctgctagcagcttgmccccgggatccaagagataaggtag

SEQ ID NO: 1795 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttcctccattaaattgccttcagyattcgattgtacacaaagttataga

SEQ ID NO: 1796 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttgtacacaaagttatagacttcayccttgacgtccagaagatccaggac

SEQ ID NO: 1797 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcaaatatggagctagggctcccamaatgaaggaagaatctgatgaatat

SEQ ID NO: 1798 - DNA, 50 bp, Artificial Sequence
  synthetic Elaeis guineensis (oil palm) single nucleotide polymorphism (SNP) in genomic region adjacent to shatterproof1 (SHELL) shell thickness gene
gccggaaggccttgatacggtggtyggtcatgagcacggagtgtagctcc

SEQ ID NO: 1799 - DNA, 50 bp, Artificial Sequence
  synthetic Elaeis guineensis (oil palm) single nucleotide polymorphism (SNP) in genomic region adjacent to shatterproof1 (SHELL) shell thickness gene
accgacctgaattggaggctgaatrttgatctgaattggaggctgaatgc

SEQ ID NO: 1800 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttagctcatataaataccgacatraagcagagtattacatatatccgag

SEQ ID NO: 1801 - DNA, 50 bp, Artificial Sequence
  synthetic Elaeis guineensis (oil palm) single nucleotide polymorphism (SNP) in genomic region adjacent to shatterproof1 (SHELL) shell thickness gene
aactggctacgatctcacgtacaaytgtgctataactcatccccaactgg

SEQ ID NO: 1802 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcttacttacagctggcctccaacrgcctaacaaactctatagctggcct

SEQ ID NO: 1803 - DNA, 50 bp, Artificial Sequence
  synthetic Elaeis guineensis (oil palm) single nucleotide polymorphism (SNP) in genomic region adjacent to shatterproof1 (SHELL) shell thickness gene
cggcctaacaaactctatagctggyctctaacggcctaacaaactcttcc

SEQ ID NO: 1804 - DNA, 50 bp, Artificial Sequence
  synthetic Elaeis guineensis (oil palm) single nucleotide polymorphism (SNP) in genomic region adjacent to shatterproof1 (SHELL) shell thickness gene
catcagtccctctataaataaaggrcaaagggatccttcaggtaagtttt

SEQ ID NO: 1805 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctactttttctatcttctattctygaggctcaaattgacttaagcatca

SEQ ID NO: 1806 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcttattttgtaggattcttcgaargagactcatattggatcaccacagc

SEQ ID NO: 1807 - DNA, 50 bp, Artificial Sequence
  synthetic Elaeis guineensis (oil palm) single nucleotide polymorphism (SNP) in genomic region adjacent to shatterproof1 (SHELL) shell thickness gene
tattggatcaccacagcctctccarcatgacttcatccaatctcttcatc

SEQ ID NO: 1808 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctgagattttgagcctcacaacaayagattggtgctagaggaagagtgat

SEQ ID NO: 1809 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaaagcacaaagcaactctatacyttgaccgtctccctctgaagatatg

SEQ ID NO: 1810 - DNA, 50 bp, Artificial Sequence
  synthetic Elaeis guineensis (oil palm) single nucleotide polymorphism (SNP) in genomic region adjacent to shatterproof1 (SHELL) shell thickness gene
acaaagcaactctatactttgaccrtctccctctgaagatatgctggaag

SEQ ID NO: 1811 - DNA, 50 bp, Artificial Sequence
  synthetic Elaeis guineensis (oil palm) single nucleotide polymorphism (SNP) in genomic region adjacent to shatterproof1 (SHELL) shell thickness gene
gctgtcaactcatggtattaatggrgacggcccccacatcctgtgaggtg

SEQ ID NO: 1812 - DNA, 50 bp, Artificial Sequence
  synthetic Elaeis guineensis (oil palm) single nucleotide polymorphism (SNP) in genomic region adjacent to shatterproof1 (SHELL) shell thickness gene
taaacaaaactcataacctctccgrtaataaattctcaagctctatctac

SEQ ID NO: 1813 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagaaaaaatcaaaacaagaataaraaaatttatccaaacgagatatcta

SEQ ID NO: 1814 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatctatttgaggaaactcaagatrcgatttgagattttaagacaatata

SEQ ID NO: 1815 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaaaagaaaaagaggagaaaatccycggacatagccgaagtcatcttaca

SEQ ID NO: 1816 - DNA, 50 bp, Artificial Sequence
  synthetic Elaeis guineensis (oil palm) single nucleotide polymorphism (SNP) in genomic region adjacent to shatterproof1 (SHELL) shell thickness gene
caccccatcggatcggcatcttcgmcactcccgtgcgcctcctggagcca

SEQ ID NO: 1817 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccaagtgccaaaacatcgtcagatyagtgacttccctccgatcgagacca

SEQ ID NO: 1818 - DNA, 50 bp, Artificial Sequence
  synthetic Elaeis guineensis (oil palm) single nucleotide polymorphism (SNP) in genomic region adjacent to shatterproof1 (SHELL) shell thickness gene
cgagaccatccgcatgctcgtgtasgtttgcagcaccaggccctaccaaa

SEQ ID NO: 1819 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaggcccagcactggcaaatcgatytccaatcctgcatcctgatggtggg

SEQ ID NO: 1820 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggctccactggattgacggcccccratgatctccagctctcctccctgtg

SEQ ID NO: 1821 - DNA, 50 bp, Artificial Sequence
  synthetic Elaeis guineensis (oil palm) single nucleotide polymorphism (SNP) in genomic region adjacent to shatterproof1 (SHELL) shell thickness gene
atctctggctctccttcctacatcygtgggtattttcggtgccgaatcca

SEQ ID NO: 1822 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttcctacatctgtgggtattttcgrtgccgaatccagtcagatcgattgc

SEQ ID NO: 1823 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaaaaaagaaaaaaaagaagaggrgagagcttgatctccagccaaagtt

SEQ ID NO: 1824 - DNA, 50 bp, Artificial Sequence
  synthetic Elaeis guineensis (oil palm) single nucleotide polymorphism (SNP) in genomic region adjacent to shatterproof1 (SHELL) shell thickness gene
acaacaagcagtcaagtagaactcrcaagttctcaaacaacaactcctgg

SEQ ID NO: 1825 - DNA, 50 bp, Artificial Sequence
  synthetic Elaeis guineensis (oil palm) single nucleotide polymorphism (SNP) in genomic region adjacent to shatterproof1 (SHELL) shell thickness gene
attcttaagcttccatttgttattytttctcttttccttcttgcaggatc

SEQ ID NO: 1826 - DNA, 50 bp, Artificial Sequence
  synthetic Elaeis guineensis (oil palm) single nucleotide polymorphism (SNP) in genomic region adjacent to shatterproof1 (SHELL) shell thickness gene
agcaaaaataagctcgaattgagayaaaacttaagtccaagctgcggcaa

SEQ ID NO: 1827 - DNA, 50 bp, Artificial Sequence
  synthetic Elaeis guineensis (oil palm) single nucleotide polymorphism (SNP) in genomic region adjacent to shatterproof1 (SHELL) shell thickness gene
gagataaaacttaagtccaagctgmggcaaagaataggaaggagtcaaat

SEQ ID NO: 1828 - DNA, 50 bp, Artificial Sequence
  synthetic Elaeis guineensis (oil palm) single nucleotide polymorphism (SNP) in genomic region adjacent to shatterproof1 (SHELL) shell thickness gene
agctgcggcaaagaataggaaggartcaaatataactcagaagctctcaa

SEQ ID NO: 1829 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttcaatattcggattggtagagccycgagaggtacaaatggagataagat

SEQ ID NO: 1830 - DNA, 50 bp, Artificial Sequence
  synthetic Elaeis guineensis (oil palm) single nucleotide polymorphism (SNP) in genomic region adjacent to shatterproof1 (SHELL) shell thickness gene
agattggtagagctccgagaggcayaaatggagataagatctcctcaaaa

SEQ ID NO: 1831 - DNA, 50 bp, Artificial Sequence
  synthetic Elaeis guineensis (oil palm) single nucleotide polymorphism (SNP) in genomic region adjacent to shatterproof1 (SHELL) shell thickness gene
tccgagaggcataaatggagataaratctcctcaaaatctaatctccgaa

SEQ ID NO: 1832 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagatctcctcaaaatctaatctcygaattggtagagtctcgaagggcca

SEQ ID NO: 1833 - DNA, 50 bp, Artificial Sequence
  synthetic Elaeis guineensis (oil palm) single nucleotide polymorphism (SNP) in genomic region adjacent to shatterproof1 (SHELL) shell thickness gene
gagattatcttcagttctataaaaktctaatctaaaggtcaagattattt

SEQ ID NO: 1834 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttggatttctatcaaataccgacytcaagtcaaagttatatcaaaattc

SEQ ID NO: 1835 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaggtcgagattatcttaaatttytatcaaataccgatctcaaatcgaa

SEQ ID NO: 1836 - DNA, 50 bp, Artificial Sequence
  synthetic Elaeis guineensis (oil palm) single nucleotide polymorphism (SNP) in genomic region adjacent to shatterproof1 (SHELL) shell thickness gene
taacttgaaattctataaaataccratctgagggtcgaggttatctttaa

SEQ ID NO: 1837 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctatcaagtaccgatctgaggatcraggttatctttcagttctataaaat

SEQ ID NO: 1838 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttttttagttctataaaatactgayctgaaggtcgaagttatcttttagt

SEQ ID NO: 1839 - DNA, 50 bp, Artificial Sequence
  synthetic Elaeis guineensis (oil palm) single nucleotide polymorphism (SNP) in genomic region adjacent to shatterproof1 (SHELL) shell thickness gene
gacctgaaggtcgaagttatctttyagttctgtaaaataccgacttgaag

SEQ ID NO: 1840 - DNA, 50 bp, Artificial Sequence
  synthetic Elaeis guineensis (oil palm) single nucleotide polymorphism (SNP) in genomic region adjacent to shatterproof1 (SHELL) shell thickness gene
ataccgatctgaaggtcgatgttawcatacagttctatgaaatactaatc

SEQ ID NO: 1841 - DNA, 50 bp, Artificial Sequence
  synthetic Elaeis guineensis (oil palm) single nucleotide polymorphism (SNP) in genomic region adjacent to shatterproof1 (SHELL) shell thickness gene
gttatctttcatttctataaaataycgatctgaaggtcgatgttatattt

SEQ ID NO: 1842 - DNA, 50 bp, Artificial Sequence
  synthetic Elaeis guineensis (oil palm) single nucleotide polymorphism (SNP) in genomic region adjacent to shatterproof1 (SHELL) shell thickness gene
agatcgaggttatcattcagttctwtcaaatactgatatgagggtcgagg

SEQ ID NO: 1843 - DNA, 50 bp, Artificial Sequence
  synthetic Elaeis guineensis (oil palm) single nucleotide polymorphism (SNP) in genomic region adjacent to shatterproof1 (SHELL) shell thickness gene
gatatgagggtcgaggttctctttyaattctataaaatatcgatctgaag

SEQ ID NO: 1844 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctataaaatatcgatctgaaggttkagattatcatttaattctataaaat

SEQ ID NO: 1845 - DNA, 50 bp, Artificial Sequence
  synthetic Elaeis guineensis (oil palm) single nucleotide polymorphism (SNP) in genomic region adjacent to shatterproof1 (SHELL) shell thickness gene
agttctatcaaatactaacctgaargttgtgattgtcttttagttctata

SEQ ID NO: 1846 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctataaaatatcgatctgaaggtsgagattgtcattcagttctatcaaa

SEQ ID NO: 1847 - DNA, 50 bp, Artificial Sequence
  synthetic Elaeis guineensis (oil palm) single nucleotide polymorphism (SNP) in genomic region adjacent to shatterproof1 (SHELL) shell thickness gene
gttctatcaaatatggatttgaggktcgaggttatatttcaattttataa

SEQ ID NO: 1848 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatctttcaattctataaaatatcracttgaaggtcgagattatctttca

SEQ ID NO: 1849 - DNA, 50 bp, Artificial Sequence
  synthetic Elaeis guineensis (oil palm) single nucleotide polymorphism (SNP) in genomic region adjacent to shatterproof1 (SHELL) shell thickness gene
cattcagttctatcaaataccgatmtgagtattgaggttatctttcaatt

SEQ ID NO: 1850 - DNA, 50 bp, Artificial Sequence
  synthetic Elaeis guineensis (oil palm) single nucleotide polymorphism (SNP) in genomic region adjacent to shatterproof1 (SHELL) shell thickness gene
cttgaaaatatcaacctgagggtcraagttatatttcagctcatataaat

SEQ ID NO: 1851 - DNA, 50 bp, Artificial Sequence
  synthetic Elaeis guineensis (oil palm) single nucleotide polymorphism (SNP) in genomic region adjacent to shatterproof1 (SHELL) shell thickness gene
agctcatataaatactgacctcatrgtcgagattatctttcagcttatat

SEQ ID NO: 1852 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgaggttttactgacctcaagattraggttatcctgcaaaatacagatct

SEQ ID NO: 1853 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccaatctccagattggtagagctcygaaagacacaaacaaagatcagatc

SEQ ID NO: 1854 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctatggatcgatattatctttcagytcgtatagatactagtcgaccttag

SEQ ID NO: 1855 - DNA, 50 bp, Artificial Sequence
  synthetic Elaeis guineensis (oil palm) single nucleotide polymorphism (SNP) in genomic region adjacent to shatterproof1 (SHELL) shell thickness gene
gctcgtatagatactagtcgacctwagggtcgaagttattttattattct

SEQ ID NO: 1856 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgatctccagatcgaagttatcttraaattctattatcgatcttcgaatt

SEQ ID NO: 1857 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaattctattatcgatcttcgaatygaagttatcttgaagttctattaaa

SEQ ID NO: 1858 - DNA, 50 bp, Artificial Sequence
  synthetic Elaeis guineensis (oil palm) single nucleotide polymorphism (SNP) in genomic region adjacent to shatterproof1 (SHELL) shell thickness gene
catctcagctcataagaaagccgaygtgaatcaaaggccaagtttacata

SEQ ID NO: 1859 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaaagccgacgtgaatcaaaggccragtttacataaagtcgatctgaatt

SEQ ID NO: 1860 - DNA, 50 bp, Artificial Sequence
  synthetic Elaeis guineensis (oil palm) single nucleotide polymorphism (SNP) in genomic region adjacent to shatterproof1 (SHELL) shell thickness gene
agatgttcagggtcccatatgatayttgatttcattttggtattttatcg

SEQ ID NO: 1861 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctccgtctgagattttgagcctcayagcaacaataataatataatataat

SEQ ID NO: 1862 - DNA, 50 bp, Artificial Sequence
  synthetic Elaeis guineensis (oil palm) single nucleotide polymorphism (SNP) in genomic region adjacent to shatterproof1 (SHELL) shell thickness gene
cgaggtggtttagctcttcatgggwataataacaaattgtttctaaccag

SEQ ID NO: 1863 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcattcataatatatcaaagcaacyagaaatcctactggttcggtccaat

SEQ ID NO: 1864 - DNA, 50 bp, Artificial Sequence
  synthetic Elaeis guineensis (oil palm) single nucleotide polymorphism (SNP) in genomic region adjacent to shatterproof1 (SHELL) shell thickness gene
catgttaaaaatacccttgtattckgcttaatataaacttatctcacaat

SEQ ID NO: 1865 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttgtattctgcttaatataaacttrtctcacaatcatttttcagtaaatt

SEQ ID NO: 1866 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttaatataaacttatctcacaatcrtttttcagtaaattaacaatgataa

SEQ ID NO: 1867 - DNA, 50 bp, Artificial Sequence
  synthetic Elaeis guineensis (oil palm) single nucleotide polymorphism (SNP) in genomic region adjacent to shatterproof1 (SHELL) shell thickness gene
atatgtaggggtaatcagaagaaaygaaagatgtgtcggtactctggtgt

SEQ ID NO: 1868 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcagaagaaatgaaagatgtgtcgrtactctggtgtcatgcatatagaaa

SEQ ID NO: 1869 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttttattcaaaaaaaatatttttrtttgtttattattctatttttctct

SEQ ID NO: 1870 - DNA, 50 bp, Artificial Sequence
  synthetic Elaeis guineensis (oil palm) single nucleotide polymorphism (SNP) in genomic region adjacent to shatterproof1 (SHELL) shell thickness gene
tattcaaaaaaaatatttttatttrtttattattctatttttctctgctc

SEQ ID NO: 1871 - DNA, 50 bp, Artificial Sequence
  synthetic Elaeis guineensis (oil palm) single nucleotide polymorphism (SNP) in genomic region adjacent to shatterproof1 (SHELL) shell thickness gene
tacagaattaccaaaaattttgcgrccatttagttcttctttcagtataa

SEQ ID NO: 1872 - DNA, 50 bp, Artificial Sequence
  synthetic Elaeis guineensis (oil palm) single nucleotide polymorphism (SNP) in genomic region adjacent to shatterproof1 (SHELL) shell thickness gene
attaccaaaaattttgcgaccattwagttcttctttcagtataatttctg

SEQ ID NO: 1873 - DNA, 50 bp, Artificial Sequence
  synthetic Elaeis guineensis (oil palm) single nucleotide polymorphism (SNP) in genomic region adjacent to shatterproof1 (SHELL) shell thickness gene
acatggtgcctcttgcaagttgatsaaagccaaattgactagcattattg

SEQ ID NO: 1874 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaagcatgaactcttacaccatgyactcgatcctgattaccagttctaa

SEQ ID NO: 1875 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttgatgtgataccaaaaatgtcaygccaccactcccctctaatttaaca

SEQ ID NO: 1876 - DNA, 50 bp, Artificial Sequence
  synthetic Elaeis guineensis (oil palm) single nucleotide polymorphism (SNP) in genomic region adjacent to shatterproof1 (SHELL) shell thickness gene
acggggttcacttgattccacagtwatcgtaccctagtctacagtagaaa

SEQ ID NO: 1877 - DNA, 50 bp, Artificial Sequence
  synthetic Elaeis guineensis (oil palm) single nucleotide polymorphism (SNP) in genomic region adjacent to shatterproof1 (SHELL) shell thickness gene
cttttttgttcatctttgatgcgtrgtagacacaacttttttgagaattg

SEQ ID NO: 1878 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgatcttctctttgctttcttgtgracgatatggaattttgatgacagca

SEQ ID NO: 1879 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaaggaatggttcttttatgtcccyagagatcgaaagtatagaaatggtg

SEQ ID NO: 1880 - DNA, 50 bp, Artificial Sequence
  synthetic Elaeis guineensis (oil palm) single nucleotide polymorphism (SNP) in genomic region adjacent to shatterproof1 (SHELL) shell thickness gene
gacgcttgtcttctactctgggaargctcctaaaggcatacgatcaagct

SEQ ID NO: 1881 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttgagctagcttttcatatctgatsttttctcttaagtcaacaagaagga

SEQ ID NO: 1882 - DNA, 50 bp, Artificial Sequence
  synthetic Elaeis guineensis (oil palm) single nucleotide polymorphism (SNP) in genomic region adjacent to shatterproof1 (SHELL) shell thickness gene
atttttctgttgctctttgtgaacyaagcttactgttttaaatttcttct

SEQ ID NO: 1883 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctttgtgaaccaagcttactgtttyaaatttcttcttcttcatcatgtcg

SEQ ID NO: 1884 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttgcagaccgaaatctcgctctgycgagtctataaaagagctggggtcg

SEQ ID NO: 1885 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcctcctcatatttttcttttcttktcttttccaacaaagactgctgaag

SEQ ID NO: 1886 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgtaactgtgggtgaaaacttattstagatcaggtttgtagttcgactaa

SEQ ID NO: 1887 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttattcatatatacgttctcatcamtgaatttagggcattttatcatctt

SEQ ID NO: 1888 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttcatatatacgttctcatcaatgratttagggcattttatcatcttcta

SEQ ID NO: 1889 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttttatcatcttctagggtctcttytggtttggcatgtatttcctaaact

SEQ ID NO: 1890 - DNA, 50 bp, Artificial Sequence
  synthetic Elaeis guineensis (oil palm) single nucleotide polymorphism (SNP) in genomic region adjacent to shatterproof1 (SHELL) shell thickness gene
tggcatgtatttcctaaactggaartatttcagatcagtagttgtgagag

SEQ ID NO: 1891 - DNA, 50 bp, Artificial Sequence
  synthetic Elaeis guineensis (oil palm) single nucleotide polymorphism (SNP) in genomic region adjacent to shatterproof1 (SHELL) shell thickness gene
atttcagatcagtagttgtgagagsagattcttagtctatatgtggtatg

SEQ ID NO: 1892 - DNA, 50 bp, Artificial Sequence
  synthetic Elaeis guineensis (oil palm) single nucleotide polymorphism (SNP) in genomic region adjacent to shatterproof1 (SHELL) shell thickness gene
tacggcctagctatgtatagatctrgcgttgcttctcactttgttcactt

SEQ ID NO: 1893 - DNA, 50 bp, Artificial Sequence
  synthetic Elaeis guineensis (oil palm) single nucleotide polymorphism (SNP) in genomic region adjacent to shatterproof1 (SHELL) shell thickness gene
cctttcttaacttggatatcgtttkcttctttgggcagtgttttagattt

SEQ ID NO: 1894 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcttttggttccagatgtcttgctragcttgggcaatctcttaggttagt

SEQ ID NO: 1895 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcaaagattgcgacgatcgataaayctgttctagaccatgttcactcact

SEQ ID NO: 1896 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcgacgaagaatggctttcggagawagctgatctacttcacatgaacttt

SEQ ID NO: 1897 - DNA, 50 bp, Artificial Sequence
  synthetic Elaeis guineensis (oil palm) single nucleotide polymorphism (SNP) in genomic region adjacent to shatterproof1 (SHELL) shell thickness gene
acttcacatgaactttcatttatgrtcatctgatccaggtccaacagtga

SEQ ID NO: 1898 - DNA, 50 bp, Artificial Sequence
  synthetic Elaeis guineensis (oil palm) single nucleotide polymorphism (SNP) in genomic region adjacent to shatterproof1 (SHELL) shell thickness gene
aacagaaagagtatatatgactgtraaactctcaattagtgagattactt

SEQ ID NO: 1899 - DNA, 50 bp, Artificial Sequence
  synthetic Elaeis guineensis (oil palm) single nucleotide polymorphism (SNP) in genomic region adjacent to shatterproof1 (SHELL) shell thickness gene
tccatctttattagctccatgaatsatgcactatcatcatgtcaatattt

SEQ ID NO: 1900 - DNA, 50 bp, Artificial Sequence
  synthetic Elaeis guineensis (oil palm) single nucleotide polymorphism (SNP) in genomic region adjacent to shatterproof1 (SHELL) shell thickness gene
attagctccatgaatcatgcactaycatcatgtcaatatttattattgta

SEQ ID NO: 1901 - DNA, 50 bp, Artificial Sequence
  synthetic Elaeis guineensis (oil palm) single nucleotide polymorphism (SNP) in genomic region adjacent to shatterproof1 (SHELL) shell thickness gene
agtttgaaaaagatgaaaagagtaycagaaccaagaaaaaaatgaacgag

SEQ ID NO: 1902 - DNA, 50 bp, Artificial Sequence
  synthetic Elaeis guineensis (oil palm) single nucleotide polymorphism (SNP) in genomic region adjacent to shatterproof1 (SHELL) shell thickness gene
caagaaaaaaatgaacgagtctctraatttttagaatattttagaagaag

SEQ ID NO: 1903 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggcaattttaatcagaaataaaaaraaatcaaaaatttgcatgattatga

SEQ ID NO: 1904 - DNA, 50 bp, Artificial Sequence
  synthetic Elaeis guineensis (oil palm) single nucleotide polymorphism (SNP) in genomic region adjacent to shatterproof1 (SHELL) shell thickness gene
gagaggctgcttcacttcttcaccygttcaaaacaatacaggatattttc

SEQ ID NO: 1905 - DNA, 50 bp, Artificial Sequence
  synthetic Elaeis guineensis (oil palm) single nucleotide polymorphism (SNP) in genomic region adjacent to shatterproof1 (SHELL) shell thickness gene
acctgttcaaaacaatacaggataytttcaactcacacatctaattgagc

SEQ ID NO: 1906 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcggggaagttagacaccagaaggmgaatagaaatgaatctcctattcta

SEQ ID NO: 1907 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatatttaggattatcagatagacytttttaggcaacattgagctagaca

SEQ ID NO: 1908 - DNA, 50 bp, Artificial Sequence
  synthetic Elaeis guineensis (oil palm) single nucleotide polymorphism (SNP) in genomic region adjacent to shatterproof1 (SHELL) shell thickness gene
aacattgagctagacatccagagcmatgagaactcacaggacggaaccaa

SEQ ID NO: 1909 - DNA, 50 bp, Artificial Sequence
  synthetic Elaeis guineensis (oil palm) single nucleotide polymorphism (SNP) in genomic region adjacent to shatterproof1 (SHELL) shell thickness gene
gattttggagctagacctgcaaccwgatctactccaagtccaaataaggt

SEQ ID NO: 1910 - DNA, 50 bp, Artificial Sequence
  synthetic Elaeis guineensis (oil palm) single nucleotide polymorphism (SNP) in genomic region adjacent to shatterproof1 (SHELL) shell thickness gene
tactccaagtccaaataaggttggmcagatcctggcccaagctcaacccg

SEQ ID NO: 1911 - DNA, 50 bp, Artificial Sequence
  synthetic Elaeis guineensis (oil palm) single nucleotide polymorphism (SNP) in genomic region adjacent to shatterproof1 (SHELL) shell thickness gene
caaataaggttggacagatcctggyccaagctcaacccgactgtttccag

SEQ ID NO: 1912 - DNA, 50 bp, Artificial Sequence
  synthetic Elaeis guineensis (oil palm) single nucleotide polymorphism (SNP) in genomic region adjacent to shatterproof1 (SHELL) shell thickness gene
agagagagacagggagagttttgtrggatatatcggttttatttggtaaa

SEQ ID NO: 1913 - DNA, 50 bp, Artificial Sequence
  synthetic Elaeis guineensis (oil palm) single nucleotide polymorphism (SNP) in genomic region adjacent to shatterproof1 (SHELL) shell thickness gene
tacctcattcaagagatgtaattgrtcgatgatgtatataattataacat

SEQ ID NO: 1914 - DNA, 50 bp, Artificial Sequence
  synthetic Elaeis guineensis (oil palm) single nucleotide polymorphism (SNP) in genomic region adjacent to shatterproof1 (SHELL) shell thickness gene
gagattaatgtgccatgccatacayctgtgagattaacagtggatagact

SEQ ID NO: 1915 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctcactagttacatttgtttggccwaggcccttgtcaggcactagtaact

SEQ ID NO: 1916 - DNA, 50 bp, Artificial Sequence
  synthetic Elaeis guineensis (oil palm) single nucleotide polymorphism (SNP) in genomic region adjacent to shatterproof1 (SHELL) shell thickness gene
cttgatgttaatgaggatcgcatakataagcatgggtaatcacataaaat

SEQ ID NO: 1917 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgatgttaatgaggatcgcatatayaagcatgggtaatcacataaaatgt

SEQ ID NO: 1918 - DNA, 50 bp, Artificial Sequence
  synthetic Elaeis guineensis (oil palm) single nucleotide polymorphism (SNP) in genomic region adjacent to shatterproof1 (SHELL) shell thickness gene
atttgctgtttacaactcacattamtaaatcactgtaacagctctctttt

SEQ ID NO: 1919 - DNA, 50 bp, Artificial Sequence
  synthetic Elaeis guineensis (oil palm) single nucleotide polymorphism (SNP) in genomic region adjacent to shatterproof1 (SHELL) shell thickness gene
ataacttgtagagtcccacaagatstcgtacaacagagattttttggtaa

SEQ ID NO: 1920 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcaaccatgcatcattgttagatamtagcctatttagccaagctacgaga

SEQ ID NO: 1921 - DNA, 50 bp, Artificial Sequence
  synthetic Elaeis guineensis (oil palm) single nucleotide polymorphism (SNP) in genomic region adjacent to shatterproof1 (SHELL) shell thickness gene
aacctacagtagctaatatgccatraccagtgttttgtcttaaaaacatt

SEQ ID NO: 1922 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagtgaataagaagaaaaaatgtgrgaggaaaactaacataataggctgt

SEQ ID NO: 1923 - DNA, 50 bp, Artificial Sequence
  synthetic Elaeis guineensis (oil palm) single nucleotide polymorphism (SNP) in genomic region adjacent to shatterproof1 (SHELL) shell thickness gene
ataggctgtataagctttaaagagrccctaagaaatattggtgaacatat

SEQ ID NO: 1924 - DNA, 50 bp, Artificial Sequence
  synthetic Elaeis guineensis (oil palm) single nucleotide polymorphism (SNP) in genomic region adjacent to shatterproof1 (SHELL) shell thickness gene
caccaagggaacccccaatatcagycccaggtacccatccaaggagagcc

SEQ ID NO: 1925 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgattgtagaactcttgaaattgcygtagaagaggctggttgaaccttat

SEQ ID NO: 1926 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttggcccagactagattggtcaasgcctccccaacagccaaccttgcca

SEQ ID NO: 1927 - DNA, 50 bp, Artificial Sequence
  synthetic Elaeis guineensis (oil palm) single nucleotide polymorphism (SNP) in genomic region adjacent to shatterproof1 (SHELL) shell thickness gene
gttcagcaaaccctttattggctgstccccaatggcacaagcaccaccag

SEQ ID NO: 1928 - DNA, 50 bp, Artificial Sequence
  synthetic Elaeis guineensis (oil palm) single nucleotide polymorphism (SNP) in genomic region adjacent to shatterproof1 (SHELL) shell thickness gene
cttcacaacattacaatttcccccrgctccctgatcatgaatactgatga

SEQ ID NO: 1929 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcctctcttcccttctcaatgacakgaaccacactaatagcctctggaac

SEQ ID NO: 1930 - DNA, 50 bp, Artificial Sequence
  synthetic Elaeis guineensis (oil palm) single nucleotide polymorphism (SNP) in genomic region adjacent to shatterproof1 (SHELL) shell thickness gene
ataaacacactctgtcattctatcmtgaaccatagctgcaaaatcattaa

SEQ ID NO: 1931 - DNA, 50 bp, Artificial Sequence
  synthetic Elaeis guineensis (oil palm) single nucleotide polymorphism (SNP) in genomic region adjacent to shatterproof1 (SHELL) shell thickness gene
caagaatttgtacgcagaagaagawtaggcctccttgatccctggaatag

SEQ ID NO: 1932 - DNA, 50 bp, Artificial Sequence
  synthetic Elaeis guineensis (oil palm) single nucleotide polymorphism (SNP) in genomic region adjacent to shatterproof1 (SHELL) shell thickness gene
taggcctccttgatccctggaatasataaagaagagattccagaacaatt

SEQ ID NO: 1933 - DNA, 50 bp, Artificial Sequence
  synthetic Elaeis guineensis (oil palm) single nucleotide polymorphism (SNP) in genomic region adjacent to shatterproof1 (SHELL) shell thickness gene
gctccttgcctgggagtcccagatktccatgttgcatgtaccatattttt

SEQ ID NO: 1934 - DNA, 50 bp, Artificial Sequence
  synthetic Elaeis guineensis (oil palm) single nucleotide polymorphism (SNP) in genomic region adjacent to shatterproof1 (SHELL) shell thickness gene
atgtttatacagttgcaatctttcsttgaggatagaacaaaaactgtaaa

SEQ ID NO: 1935 - DNA, 50 bp, Artificial Sequence
  synthetic Elaeis guineensis (oil palm) single nucleotide polymorphism (SNP) in genomic region adjacent to shatterproof1 (SHELL) shell thickness gene
atttatgatttagctgccagagatrgtggacaatctaataacctgtttgc

SEQ ID NO: 1936 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttttcttttcttttctcttttttyggttggtttaagatggggagttctt

SEQ ID NO: 1937 - DNA, 50 bp, Artificial Sequence
  synthetic Elaeis guineensis (oil palm) single nucleotide polymorphism (SNP) in genomic region adjacent to shatterproof1 (SHELL) shell thickness gene
gagcatgtgcaagagggtcttgttrgctgggctgagaaggtaaagaggag

SEQ ID NO: 1938 - DNA, 50 bp, Artificial Sequence
  synthetic Elaeis guineensis (oil palm) single nucleotide polymorphism (SNP) in genomic region adjacent to shatterproof1 (SHELL) shell thickness gene
atgcaatccatcaattggccagcawctatgatactataacttatatatcc

SEQ ID NO: 1939 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctagtcaggtgctcaatgttatatygatatccaaatagattcagatccca

SEQ ID NO: 1940 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttgagcaatcaagaagagtgtacrcacttagcaacaacccctaccttca

SEQ ID NO: 1941 - DNA, 50 bp, Artificial Sequence
  synthetic Elaeis guineensis (oil palm) single nucleotide polymorphism (SNP) in genomic region adjacent to shatterproof1 (SHELL) shell thickness gene
agaaaagaagactgggatgaagaaraaagtggtctccctatttcaaatat

SEQ ID NO: 1942 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaaaagaagactgggatgaagaaaraagtggtctccctatttcaaatatt

SEQ ID NO: 1943 - DNA, 50 bp, Artificial Sequence
  synthetic Elaeis guineensis (oil palm) single nucleotide polymorphism (SNP) in genomic region adjacent to shatterproof1 (SHELL) shell thickness gene
cttccattttcttcttgtcacttcsacccaagtttttctttccccctttc

SEQ ID NO: 1944 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcctttttattaaaacaacttattsaagtagtctacaagtacgttaggtg

SEQ ID NO: 1945 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggtgcaactatgacagtacaataamaatggcgatgttcctttaagtcagc

SEQ ID NO: 1946 - DNA, 50 bp, Artificial Sequence
  synthetic Elaeis guineensis (oil palm) single nucleotide polymorphism (SNP) in genomic region adjacent to shatterproof1 (SHELL) shell thickness gene
gggagttgacaaaaatacagggggraaatgatggacaagatattggttgt

SEQ ID NO: 1947 - DNA, 50 bp, Artificial Sequence
  synthetic Elaeis guineensis (oil palm) single nucleotide polymorphism (SNP) in genomic region adjacent to shatterproof1 (SHELL) shell thickness gene
taatattattaaaattttttaacakaatagttcacgtaatttacatataa

SEQ ID NO: 1948 - DNA, 50 bp, Artificial Sequence
  synthetic Elaeis guineensis (oil palm) single nucleotide polymorphism (SNP) in genomic region adjacent to shatterproof1 (SHELL) shell thickness gene
catataactcttcttatatctgatrtggtatagttcaagaaaaaaaaaaa

SEQ ID NO: 1949 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctgatgccgaaaccctaatttttarcgattttcttttggcagatatttct

SEQ ID NO: 1950 - DNA, 50 bp, Artificial Sequence
  synthetic Elaeis guineensis (oil palm) single nucleotide polymorphism (SNP) in genomic region adjacent to shatterproof1 (SHELL) shell thickness gene
cagtcttagctctcatccttatctraaattttttaaaaaagtttgtcctt

SEQ ID NO: 1951 - DNA, 50 bp, Artificial Sequence
  synthetic Elaeis guineensis (oil palm) single nucleotide polymorphism (SNP) in genomic region adjacent to shatterproof1 (SHELL) shell thickness gene
agcataaaacccgtgctacattgtrggttttaataaatagaagacagagt

SEQ ID NO: 1952 - DNA, 50 bp, Artificial Sequence
  synthetic Elaeis guineensis (oil palm) single nucleotide polymorphism (SNP) in genomic region adjacent to shatterproof1 (SHELL) shell thickness gene
aattgatgttccctaatctgaaaayatagttggaagaatagaaaattaaa

SEQ ID NO: 1953 - DNA, 50 bp, Artificial Sequence
  synthetic Elaeis guineensis (oil palm) single nucleotide polymorphism (SNP) in genomic region adjacent to shatterproof1 (SHELL) shell thickness gene
taaccctagccccaaccctaaccckaaccctaaccttcaaaaatctaact

SEQ ID NO: 1954 - DNA, 50 bp, Artificial Sequence
  synthetic Elaeis guineensis (oil palm) single nucleotide polymorphism (SNP) in genomic region adjacent to shatterproof1 (SHELL) shell thickness gene
cgatttttcttatctgctgccaccmtcttcgatctttctaatcctcaata

SEQ ID NO: 1955 - DNA, 50 bp, Artificial Sequence
  synthetic Elaeis guineensis (oil palm) single nucleotide polymorphism (SNP) in genomic region adjacent to shatterproof1 (SHELL) shell thickness gene
ataagataatccatgctttggcatyaatattttttgattttttctcaaaa

SEQ ID NO: 1956 - DNA, 50 bp, Artificial Sequence
  synthetic Elaeis guineensis (oil palm) single nucleotide polymorphism (SNP) in genomic region adjacent to shatterproof1 (SHELL) shell thickness gene
cagatcgctatcttctttttcaaaygaagcatcatattttttctacatgc

SEQ ID NO: 1957 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcatactaccccctttctgtgcctyctcctcccttccatccggctccacc

SEQ ID NO: 1958 - DNA, 50 bp, Artificial Sequence
  synthetic Elaeis guineensis (oil palm) single nucleotide polymorphism (SNP) in genomic region adjacent to shatterproof1 (SHELL) shell thickness gene
aggtggagcacagcgactagggcaytgtcgaggcatccttcttcccatgc

SEQ ID NO: 1959 - DNA, 50 bp, Artificial Sequence
  synthetic Elaeis guineensis (oil palm) single nucleotide polymorphism (SNP) in genomic region adjacent to shatterproof1 (SHELL) shell thickness gene
cgggcggtaggggtacagtcttgarggcacgggagagggagcaggtggct

SEQ ID NO: 1960 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggtaggggtacagtcttgaaggcaygggagagggagcaggtggctccgat

SEQ ID NO: 1961 - DNA, 50 bp, Artificial Sequence
  synthetic Elaeis guineensis (oil palm) single nucleotide polymorphism (SNP) in genomic region adjacent to shatterproof1 (SHELL) shell thickness gene
gccgatctttaggcggttctttggrttgtgttgagccaagaggtgaagca

SEQ ID NO: 1962 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgggattattgagattttggcgggkgtagagcagaaaatcgaggccgaag

SEQ ID NO: 1963 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttggcccgagcccagcctaaatgrttttgagccgagcccaaagcttgac

SEQ ID NO: 1964 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtgaagaaggaaaatagactcttaraaaattgtgcacttcatatttcttc

SEQ ID NO: 1965 - DNA, 50 bp, Artificial Sequence
  synthetic Elaeis guineensis (oil palm) single nucleotide polymorphism (SNP) in genomic region adjacent to shatterproof1 (SHELL) shell thickness gene
agaacgaaaaattcatcgaactacrctatttcttggagaagtgccaaaaa

SEQ ID NO: 1966 - DNA, 50 bp, Artificial Sequence
  synthetic Elaeis guineensis (oil palm) single nucleotide polymorphism (SNP) in genomic region adjacent to shatterproof1 (SHELL) shell thickness gene
atcctcggatcgatccaaccgacayccgactctacccaccggacagacag

SEQ ID NO: 1967 - DNA, 50 bp, Artificial Sequence
  synthetic Elaeis guineensis (oil palm) single nucleotide polymorphism (SNP) in genomic region adjacent to shatterproof1 (SHELL) shell thickness gene
caccttgtccgaaggatgggttcgkattattctttccctattggtaattc

SEQ ID NO: 1968 - DNA, 50 bp, Artificial Sequence
  synthetic Elaeis guineensis (oil palm) single nucleotide polymorphism (SNP) in genomic region adjacent to shatterproof1 (SHELL) shell thickness gene
agagaagtgcataaggattgattcrtttgaagccaagtaggccttattgc

SEQ ID NO: 1969 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaggattgtctcaaatggagcacrtgatttcacaaaggtgacttgtcag

SEQ ID NO: 1970 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttcttactattttgattcccttgcrtatataatcttagcaatcattgtat

SEQ ID NO: 1971 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctggagtagcaagagatgctgtacyggagttactaggtttcttggtggag

SEQ ID NO: 1972 - DNA, 50 bp, Artificial Sequence
  synthetic Elaeis guineensis (oil palm) single nucleotide polymorphism (SNP) in genomic region adjacent to shatterproof1 (SHELL) shell thickness gene
cacccatttttaaaagagaacatgrcattcataaaatggggcagacaggt

SEQ ID NO: 1973 - DNA, 50 bp, Artificial Sequence
  synthetic Elaeis guineensis (oil palm) single nucleotide polymorphism (SNP) in genomic region adjacent to shatterproof1 (SHELL) shell thickness gene
gatgcagcaggaagaaagaagaaamaaaacaaaaataaaaaacaatcaaa

SEQ ID NO: 1974 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttatttggaagaggttaaggttaayggcgatgatttatcatcataaaata

SEQ ID NO: 1975 - DNA, 50 bp, Artificial Sequence
  synthetic Elaeis guineensis (oil palm) single nucleotide polymorphism (SNP) in genomic region adjacent to shatterproof1 (SHELL) shell thickness gene
agcttcttggacaaaggaagatctycttagaaactagtcttgattttcct

SEQ ID NO: 1976 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcttcttggacaaaggaagatctcmttagaaactagtcttgattttcctt

SEQ ID NO: 1977 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatgatccactacatggaatagttwatgaagcaagtaatgagtatttact

SEQ ID NO: 1978 - DNA, 50 bp, Artificial Sequence
  synthetic Elaeis guineensis (oil palm) single nucleotide polymorphism (SNP) in genomic region adjacent to shatterproof1 (SHELL) shell thickness gene
actacatggaatagtttatgaagcmagtaatgagtatttacttcttagag

SEQ ID NO: 1979 - DNA, 50 bp, Artificial Sequence
  synthetic Elaeis guineensis (oil palm) single nucleotide polymorphism (SNP) in genomic region adjacent to shatterproof1 (SHELL) shell thickness gene
caagtaatgagtatttacttcttasagttagagcagtgccgacaatggaa

SEQ ID NO: 1980 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcaaaccataggagcgcaggatacrctcagcaacgagacagccaacaaat

SEQ ID NO: 1981 - DNA, 50 bp, Artificial Sequence
  synthetic Elaeis guineensis (oil palm) single nucleotide polymorphism (SNP) in genomic region adjacent to shatterproof1 (SHELL) shell thickness gene
taaattcctctctgacgtgggactytaaggttcttgcaaacttgagtttg

SEQ ID NO: 1982 - DNA, 50 bp, Artificial Sequence
  synthetic Elaeis guineensis (oil palm) single nucleotide polymorphism (SNP) in genomic region adjacent to shatterproof1 (SHELL) shell thickness gene
caaggaaactggtaatccactgctrttgagaaggagatagccttcaactt

SEQ ID NO: 1983 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcagtccaagaaaattgaagatctwattttcaacaacatattatgtggaa

SEQ ID NO: 1984 - DNA, 50 bp, Artificial Sequence
  synthetic Elaeis guineensis (oil palm) single nucleotide polymorphism (SNP) in genomic region adjacent to shatterproof1 (SHELL) shell thickness gene
cagtccaagaaaattgaagatctamttttcaacaacatattatgtggaaa

SEQ ID NO: 1985 - DNA, 50 bp, Artificial Sequence
  synthetic Elaeis guineensis (oil palm) single nucleotide polymorphism (SNP) in genomic region adjacent to shatterproof1 (SHELL) shell thickness gene
aacacaaactgggctcttggagttkgaagaaattaacatgcaggcagttc

SEQ ID NO: 1986 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatggatggaaaaataaaaaattcwatccttccctctcagcctttggctt

SEQ ID NO: 1987 - DNA, 50 bp, Artificial Sequence
  synthetic Elaeis guineensis (oil palm) single nucleotide polymorphism (SNP) in genomic region adjacent to shatterproof1 (SHELL) shell thickness gene
atccagagcacatgtaaataatagrcacccaaatgcttgtgtaggttcaa

SEQ ID NO: 1988 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcatggcacgaaaggcaaccaagcracggtgcacctaccagaacagcgca

SEQ ID NO: 1989 - DNA, 50 bp, Artificial Sequence
  synthetic Elaeis guineensis (oil palm) single nucleotide polymorphism (SNP) in genomic region adjacent to shatterproof1 (SHELL) shell thickness gene
gttagatttgaaaaatagatcccakattagattagtatatttgatataaa

SEQ ID NO: 1990 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaaattaattaaagatgataataytatctcaatattaaaaaattatttt

SEQ ID NO: 1991 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggagcagaagaagttgccgacttarattattctcctaaaacatgaccaat

SEQ ID NO: 1992 - DNA, 50 bp, Artificial Sequence
  synthetic Elaeis guineensis (oil palm) single nucleotide polymorphism (SNP) in genomic region adjacent to shatterproof1 (SHELL) shell thickness gene
attctcctaaaacatgaccaatatmtaacatccgaacgctggaaataaga

SEQ ID NO: 1993 - DNA, 50 bp, Artificial Sequence
  synthetic Elaeis guineensis (oil palm) single nucleotide polymorphism (SNP) in genomic region adjacent to shatterproof1 (SHELL) shell thickness gene
actaacatgaaagattttaggaatraatttgcaaaaaccgtttcttattt

SEQ ID NO: 1994 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttatagctatcgttttgaatatatrataaataaataaataaataaataat

SEQ ID NO: 1995 - DNA, 50 bp, Artificial Sequence
  synthetic Elaeis guineensis (oil palm) single nucleotide polymorphism (SNP) in genomic region adjacent to shatterproof1 (SHELL) shell thickness gene
aataaataaataaataaataaatawtttttatatataataaatataaata

SEQ ID NO: 1996 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctaatatccaactgtttagcaccrttaaattattccaaaatgttggaat

SEQ ID NO: 1997 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccattaaattattccaaaatgttgraattgtgactatgacgtaccaaact

SEQ ID NO: 1998 - DNA, 50 bp, Artificial Sequence
  synthetic Elaeis guineensis (oil palm) single nucleotide polymorphism (SNP) in genomic region adjacent to shatterproof1 (SHELL) shell thickness gene
gactatgacgtaccaaactaaattygaattcgaatctaattttattctga

SEQ ID NO: 1999 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttaagtctctaaattttttaaattraataaaaaatctctaaaatattagc

SEQ ID NO: 2000 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatttttaaattcctgtcgtctacrtagattgattacataggtctatgtt

SEQ ID NO: 2001 - DNA, 50 bp, Artificial Sequence
  synthetic Elaeis guineensis (oil palm) single nucleotide polymorphism (SNP) in genomic region adjacent to shatterproof1 (SHELL) shell thickness gene
ataggtctatgtttaggttacacgratttatgctcaagttacacagattt

SEQ ID NO: 2002 - DNA, 50 bp, Artificial Sequence
  synthetic Elaeis guineensis (oil palm) single nucleotide polymorphism (SNP) in genomic region adjacent to shatterproof1 (SHELL) shell thickness gene
taggttacacgaatttatgctcaarttacacagatttatgttcaagttac

SEQ ID NO: 2003 - DNA, 50 bp, Artificial Sequence
  synthetic Elaeis guineensis (oil palm) single nucleotide polymorphism (SNP) in genomic region adjacent to shatterproof1 (SHELL) shell thickness gene
cgaatttatgctcaagttacacagrtttatgttcaagttacacaagttgc

SEQ ID NO: 2004 - DNA, 50 bp, Artificial Sequence
  synthetic Elaeis guineensis (oil palm) single nucleotide polymorphism (SNP) in genomic region adjacent to shatterproof1 (SHELL) shell thickness gene
atttgtaggtattgtgcagatgatrttttggtctatgattgatggattta

SEQ ID NO: 2005 - DNA, 50 bp, Artificial Sequence
  synthetic Elaeis guineensis (oil palm) single nucleotide polymorphism (SNP) in genomic region adjacent to shatterproof1 (SHELL) shell thickness gene
acatataagcatgaacctgatacawgagaaacttagaataatggtactac

SEQ ID NO: 2006 - DNA, 50 bp, Artificial Sequence
  synthetic Elaeis guineensis (oil palm) single nucleotide polymorphism (SNP) in genomic region adjacent to shatterproof1 (SHELL) shell thickness gene
gttaaagtccttgctgttgacatgwaaataaatgctgactgctttgtatg

SEQ ID NO: 2007 - DNA, 50 bp, Artificial Sequence
  synthetic Elaeis guineensis (oil palm) single nucleotide polymorphism (SNP) in genomic region adjacent to shatterproof1 (SHELL) shell thickness gene
cagttcatcaaacttttggacaccrgtggttataactttacaattcatca

SEQ ID NO: 2008 - DNA, 50 bp, Artificial Sequence
  synthetic Elaeis guineensis (oil palm) single nucleotide polymorphism (SNP) in genomic region adjacent to shatterproof1 (SHELL) shell thickness gene
aattcatcatccttgacctttttcrataattaaattaataattgtaacca

SEQ ID NO: 2009 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatttagagcaattagtggatctarttgtcctggtcatttatgtcaatta

SEQ ID NO: 2010 - DNA, 50 bp, Artificial Sequence
  synthetic Elaeis guineensis (oil palm) single nucleotide polymorphism (SNP) in genomic region adjacent to shatterproof1 (SHELL) shell thickness gene
accttgcaggtacgtggcatttgtyatgctttgggtttgaagcgtgatag

SEQ ID NO: 2011 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaacattgagggcctataaaagcyctaaaataaggtatggcaacattga

SEQ ID NO: 2012 - DNA, 50 bp, Artificial Sequence
  synthetic Elaeis guineensis (oil palm) single nucleotide polymorphism (SNP) in genomic region adjacent to shatterproof1 (SHELL) shell thickness gene
acattgatctaactaagccctgttyggccaaggttggttcaggggtttac

SEQ ID NO: 2013 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggttcaggggtttacaattttgacygggttggagtagatttttattaacc

SEQ ID NO: 2014 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctttaaaaatgctaaagcatccatrtataggctctgtttaggtaatcttg

SEQ ID NO: 2015 - DNA, 50 bp, Artificial Sequence
  synthetic Elaeis guineensis (oil palm) single nucleotide polymorphism (SNP) in genomic region adjacent to shatterproof1 (SHELL) shell thickness gene
tccatataaataggggtgtgtactraatcagaacaggttttcctcaaaaa

SEQ ID NO: 2016 - DNA, 50 bp, Artificial Sequence
  synthetic Elaeis guineensis (oil palm) single nucleotide polymorphism (SNP) in genomic region adjacent to shatterproof1 (SHELL) shell thickness gene
cccagtcttcatatgttaaatatgyggcttagttggtgattcgagcaaaa

SEQ ID NO: 2017 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggtctctaatcatcagattggaagraagaaaatagaaagcaaaaatactg

SEQ ID NO: 2018 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgatgatatgtgatcatttctgtcrtgactgtcgaatagaaatattttta

SEQ ID NO: 2019 - DNA, 50 bp, Artificial Sequence
  synthetic Elaeis guineensis (oil palm) single nucleotide polymorphism (SNP) in genomic region adjacent to shatterproof1 (SHELL) shell thickness gene
atggtttgattataattaattgaartttagaataaacataaaaatcctaa

SEQ ID NO: 2020 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaataaacataaaaatcctaaaaartttagagtttttggcgtaattaagt

SEQ ID NO: 2021 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttggcgtaattaagtctttttttrtgcttatattttacatgttggattc

SEQ ID NO: 2022 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcttctctcacaaaaaatccttctrtcaaaacttctaccacagcatggag

SEQ ID NO: 2023 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtaggtgaggaggagtttggtggaraggatggcgtcggtgtagaggccag

SEQ ID NO: 2024 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgccttagccaccctagttgcccamaagccaatagcaagctgaccatgac

SEQ ID NO: 2025 - DNA, 50 bp, Artificial Sequence
  synthetic Elaeis guineensis (oil palm) single nucleotide polymorphism (SNP) in genomic region adjacent to shatterproof1 (SHELL) shell thickness gene
tacttcccaagcttgatccacatcyaatgcacaatccagagaaaagcatc

SEQ ID NO: 2026 - DNA, 50 bp, Artificial Sequence
  synthetic Elaeis guineensis (oil palm) single nucleotide polymorphism (SNP) in genomic region adjacent to shatterproof1 (SHELL) shell thickness gene
gacttccaaaaattttcatggcttkttaacttgtttccaagaagatggct

SEQ ID NO: 2027 - DNA, 50 bp, Artificial Sequence
  synthetic Elaeis guineensis (oil palm) single nucleotide polymorphism (SNP) in genomic region adjacent to shatterproof1 (SHELL) shell thickness gene
caggcaactgcagatatttaatttraactatatttagaataacctaaaga

SEQ ID NO: 2028 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttatttgcatgatgcaatttcatcrtcttgctttttgatgttaacttgac

SEQ ID NO: 2029 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaagcatgcgattacaatgagcgwctgtcggtaacagcccttgaatact

SEQ ID NO: 2030 - DNA, 50 bp, Artificial Sequence
  synthetic Elaeis guineensis (oil palm) single nucleotide polymorphism (SNP) in genomic region adjacent to shatterproof1 (SHELL) shell thickness gene
atatgggaagcaataaaagcatgcrattacaatgagcgactgtcggtaac

SEQ ID NO: 2031 - DNA, 50 bp, Artificial Sequence
  synthetic Elaeis guineensis (oil palm) single nucleotide polymorphism (SNP) in genomic region adjacent to shatterproof1 (SHELL) shell thickness gene
aacttgtttattttgagaatttgcrtaattgagatttgacagattaatca

SEQ ID NO: 2032 - DNA, 50 bp, Artificial Sequence
  synthetic Elaeis guineensis (oil palm) single nucleotide polymorphism (SNP) in genomic region adjacent to shatterproof1 (SHELL) shell thickness gene
acgtcctgttggtctacattaccayttgaaaattccacccaagaaaatca

SEQ ID NO: 2033 - DNA, 50 bp, Artificial Sequence
  synthetic Elaeis guineensis (oil palm) single nucleotide polymorphism (SNP) in genomic region adjacent to shatterproof1 (SHELL) shell thickness gene
atatattctgaaaggttaaaatagrcaacagcaatattggtatctagcat

SEQ ID NO: 2034 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagtcaatagtaaaatgactaaaakagattttgaagtatcatggcaaaat

SEQ ID NO: 2035 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaggaagaagagaagaggaaggagraaaaaaatggagcactactttcaaa

SEQ ID NO: 2036 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaatgttaaatgatagtgtttactrcaacacttctttaataatattttat

SEQ ID NO: 2037 - DNA, 50 bp, Artificial Sequence
  synthetic Elaeis guineensis (oil palm) single nucleotide polymorphism (SNP) in genomic region adjacent to shatterproof1 (SHELL) shell thickness gene
caaggggagtagaaacttaggaaawacattcaaggcttccgcgggaggag

SEQ ID NO: 2038 - DNA, 50 bp, Artificial Sequence
  synthetic Elaeis guineensis (oil palm) single nucleotide polymorphism (SNP) in genomic region adjacent to shatterproof1 (SHELL) shell thickness gene
gacgtggctgacgtccgggccgagkgctagggctttaagagattctaggg

SEQ ID NO: 2039 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagaggacctctccggaatcgacgyggctgacgtccgggccgagggctag

SEQ ID NO: 2040 - DNA, 50 bp, Artificial Sequence
  synthetic Elaeis guineensis (oil palm) single nucleotide polymorphism (SNP) in genomic region adjacent to shatterproof1 (SHELL) shell thickness gene
cgtatccatcggcggttctggaggsgagccgttcggaggagaggccgatg

SEQ ID NO: 2041 - DNA, 50 bp, Artificial Sequence
  synthetic Elaeis guineensis (oil palm) single nucleotide polymorphism (SNP) in genomic region adjacent to shatterproof1 (SHELL) shell thickness gene
caccctagacatcagctgctcaaasaaaagaaaaacaactcctaaattta

SEQ ID NO: 2042 - DNA, 50 bp, Artificial Sequence
  synthetic Elaeis guineensis (oil palm) single nucleotide polymorphism (SNP) in genomic region adjacent to shatterproof1 (SHELL) shell thickness gene
taattttttttttaaaaaaaaagayaggtaaaaattcaagcaaagaggac

SEQ ID NO: 2043 - DNA, 50 bp, Artificial Sequence
  synthetic Elaeis guineensis (oil palm) single nucleotide polymorphism (SNP) in genomic region adjacent to shatterproof1 (SHELL) shell thickness gene
actaccttgcatcaatctctactaycaagcctgaaataagccaatgaaat

SEQ ID NO: 2044 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcaattttagtgccttacttcactyaggcgagcgcttttctgacgcccct

SEQ ID NO: 2045 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttcatgttacaatagttatcactarttgttatttatttatatatcatact

SEQ ID NO: 2046 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccaatgaaggaagagaagacgaaastgatgacaacttcgcaagtgaaact

SEQ ID NO: 2047 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaacctaaaagaccgcccatttaayttctcagctccattactaacagggg

SEQ ID NO: 2048 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttttttaatgactgaaaagtgtaaraaacctaaaagaccgcccatttaac

SEQ ID NO: 2049 - DNA, 50 bp, Artificial Sequence
  synthetic Elaeis guineensis (oil palm) single nucleotide polymorphism (SNP) in genomic region adjacent to shatterproof1 (SHELL) shell thickness gene
cacctcagacgctcaagtgaggtgycagaaggggtcaccaccccttgata

SEQ ID NO: 2050 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatatatgccatcaatccaatgatrtcaaaagtgccaaaaggcgcacctc

SEQ ID NO: 2051 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatttcaacttaaaaaagtgccagktacagaaagcaaacaactcaaggct

SEQ ID NO: 2052 - DNA, 50 bp, Artificial Sequence
  synthetic Elaeis guineensis (oil palm) single nucleotide polymorphism (SNP) in genomic region adjacent to shatterproof1 (SHELL) shell thickness gene
tggcatctacctatttaaaaagttyagaaggaaaacctgcacacagcccc

SEQ ID NO: 2053 - DNA, 50 bp, Artificial Sequence
  synthetic Elaeis guineensis (oil palm) single nucleotide polymorphism (SNP) in genomic region adjacent to shatterproof1 (SHELL) shell thickness gene
tataaatctctaattctatttcttmacttgatcgagcccataaaattaat

SEQ ID NO: 2054 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctacgaatgaattggcccaaggccrggatgttgctaggccttgtcattag

SEQ ID NO: 2055 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaaggatgggccaacccgtgcttgmctggaatttttatattgttcatgat

SEQ ID NO: 2056 - DNA, 50 bp, Artificial Sequence
  synthetic Elaeis guineensis (oil palm) single nucleotide polymorphism (SNP) in genomic region adjacent to shatterproof1 (SHELL) shell thickness gene
gacatttgtacctctatattgcatrctaatccatgttgattcacgtaagc

SEQ ID NO: 2057 - DNA, 50 bp, Artificial Sequence
  synthetic Elaeis guineensis (oil palm) single nucleotide polymorphism (SNP) in genomic region adjacent to shatterproof1 (SHELL) shell thickness gene
cgctacaaaacaagcatctaacaasaagtcaaaagcaatcagaaaaaacc

SEQ ID NO: 2058 - DNA, 50 bp, Artificial Sequence
  synthetic Elaeis guineensis (oil palm) single nucleotide polymorphism (SNP) in genomic region adjacent to shatterproof1 (SHELL) shell thickness gene
attttgtgtgcatgactcaaacaamtgcccatattgatcttcacatccag

SEQ ID NO: 2059 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgattcggattcggattttcttacracattcaggttgagttcacattcat

SEQ ID NO: 2060 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaattaaaacaatatgaaataattstagaagtaacaatatctttgaaatc

SEQ ID NO: 2061 - DNA, 50 bp, Artificial Sequence
  synthetic Elaeis guineensis (oil palm) single nucleotide polymorphism (SNP) in genomic region adjacent to shatterproof1 (SHELL) shell thickness gene
catcaggaggcaaacacaacacaaycataattcccctagtctggctatca

SEQ ID NO: 2062 - DNA, 50 bp, Artificial Sequence
  synthetic Elaeis guineensis (oil palm) single nucleotide polymorphism (SNP) in genomic region adjacent to shatterproof1 (SHELL) shell thickness gene
cttccccctctctcttcctctctcrttctcccttcaccctctctctgtgt

SEQ ID NO: 2063 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcaatagtggtgcagcaagctcaaytgccctccggagtccctctctcctt

SEQ ID NO: 2064 - DNA, 50 bp, Artificial Sequence
  synthetic Elaeis guineensis (oil palm) single nucleotide polymorphism (SNP) in genomic region adjacent to shatterproof1 (SHELL) shell thickness gene
aggaggggctccgccctcttgatcraaataggggcttcggtctctgtttc

SEQ ID NO: 2065 - DNA, 50 bp, Artificial Sequence
  synthetic Elaeis guineensis (oil palm) single nucleotide polymorphism (SNP) in genomic region adjacent to shatterproof1 (SHELL) shell thickness gene
aggaaaggaaaaggaggttccccgraggcctttggagggctagcaaggcc

SEQ ID NO: 2066 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctcaatataactgaatatcagaggyggaactgcaaacaacaacctattct

SEQ ID NO: 2067 - DNA, 50 bp, Artificial Sequence
  synthetic Elaeis guineensis (oil palm) single nucleotide polymorphism (SNP) in genomic region adjacent to shatterproof1 (SHELL) shell thickness gene
caagcataatgtcacgttcatatcrtgagatattaatcactgtcctttgt

SEQ ID NO: 2068 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcaacaatcactacatccaaaggcmggtgccttatttttcttcaagatgc

SEQ ID NO: 2069 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaggaaggtgagcagagcattccartttctcaaagggcagttaatatgat

SEQ ID NO: 2070 - DNA, 50 bp, Artificial Sequence
  synthetic Elaeis guineensis (oil palm) single nucleotide polymorphism (SNP) in genomic region adjacent to shatterproof1 (SHELL) shell thickness gene
taacaagagtaacacattacagcckaatgcagggctcatttaatatccat

SEQ ID NO: 2071 - DNA, 50 bp, Artificial Sequence
  synthetic Elaeis guineensis (oil palm) single nucleotide polymorphism (SNP) in genomic region adjacent to shatterproof1 (SHELL) shell thickness gene
cagacttgacataagtgctctggcrcaataaggactctcataaatcagat

SEQ ID NO: 2072 - DNA, 50 bp, Artificial Sequence
  synthetic Elaeis guineensis (oil palm) single nucleotide polymorphism (SNP) in genomic region adjacent to shatterproof1 (SHELL) shell thickness gene
atattctcagtattgtgggtgaggragagtaaagggtcagacttgacata

SEQ ID NO: 2073 - DNA, 50 bp, Artificial Sequence
  synthetic Elaeis guineensis (oil palm) single nucleotide polymorphism (SNP) in genomic region adjacent to shatterproof1 (SHELL) shell thickness gene
aattagtgttattttaaagcatccyttttttgaagcacagctggtgagaa

SEQ ID NO: 2074 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgcttacaataaagtcactttaatmtgaagccatatcttagataaattag

SEQ ID NO: 2075 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgagttcagaaatcagcatttgacygtgcatgtaattaatggtttgtgga

SEQ ID NO: 2076 - DNA, 50 bp, Artificial Sequence
  synthetic Elaeis guineensis (oil palm) single nucleotide polymorphism (SNP) in genomic region adjacent to shatterproof1 (SHELL) shell thickness gene
cttttctacattatcttagattagrtggatatggaagtgagttcagaaat

SEQ ID NO: 2077 - DNA, 50 bp, Artificial Sequence
  synthetic Elaeis guineensis (oil palm) single nucleotide polymorphism (SNP) in genomic region adjacent to shatterproof1 (SHELL) shell thickness gene
cttggttatgttttatcctaagcayataggaacaaaagtaagccaaggaa

SEQ ID NO: 2078 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtttcaggagtgtcaggaaggaggwactacagagcaaaaataaagaaagg

SEQ ID NO: 2079 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtctgaaataggaacaaaactaacytagttctcacctaagcatataattt

SEQ ID NO: 2080 - DNA, 50 bp, Artificial Sequence
  synthetic Elaeis guineensis (oil palm) single nucleotide polymorphism (SNP) in genomic region adjacent to shatterproof1 (SHELL) shell thickness gene
taaaaagaatagagaaaaagcttgragtaacgaaagcaattaacaaaagt

SEQ ID NO: 2081 - DNA, 50 bp, Artificial Sequence
  synthetic Elaeis guineensis (oil palm) single nucleotide polymorphism (SNP) in genomic region adjacent to shatterproof1 (SHELL) shell thickness gene
caaaaatccacaaaatgctttattwgtctccctgtacaacaaaataaaaa

SEQ ID NO: 2082 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagggacttggcccaattaaatcamtttatggagtcccttcatcaggata

SEQ ID NO: 2083 - DNA, 50 bp, Artificial Sequence
  synthetic Elaeis guineensis (oil palm) single nucleotide polymorphism (SNP) in genomic region adjacent to shatterproof1 (SHELL) shell thickness gene
acagaccgtgcaggatcaagaaagmagaaaaggagaaaagggacttggcc

SEQ ID NO: 2084 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggaacaaggaaacctaatcagacaraccgtgcaggatcaagaaagcagaa

SEQ ID NO: 2085 - DNA, 50 bp, Artificial Sequence
  synthetic Elaeis guineensis (oil palm) single nucleotide polymorphism (SNP) in genomic region adjacent to shatterproof1 (SHELL) shell thickness gene
agaatctcacaaagagaatacctgygatgcagctagccactggatcatac

SEQ ID NO: 2086 - DNA, 50 bp, Artificial Sequence
  synthetic Elaeis guineensis (oil palm) single nucleotide polymorphism (SNP) in genomic region adjacent to shatterproof1 (SHELL) shell thickness gene
tccaacagttatggaagacatattygaacaaaggaatgagttgaatcacc

SEQ ID NO: 2087 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagtcacccactgtccatccatgcrccaaggtccattgagtcacctgatt

SEQ ID NO: 2088 - DNA, 50 bp, Artificial Sequence
  synthetic Elaeis guineensis (oil palm) single nucleotide polymorphism (SNP) in genomic region adjacent to shatterproof1 (SHELL) shell thickness gene
agaatgacactactcagacatacaytgcacgtcatttgatgtgctgtgat

SEQ ID NO: 2089 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaagaatgacactactcagacatayattgcacgtcatttgatgtgctgtg

SEQ ID NO: 2090 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagaaaaagagctaaatgagtcacrccttagaagaaatataaatattaaa

SEQ ID NO: 2091 - DNA, 50 bp, Artificial Sequence
  synthetic Elaeis guineensis (oil palm) single nucleotide polymorphism (SNP) in genomic region adjacent to shatterproof1 (SHELL) shell thickness gene
tccatgccagcaggaaaacaaaagmacgcatcttatgactgccccaacaa

SEQ ID NO: 2092 - DNA, 50 bp, Artificial Sequence
  synthetic Elaeis guineensis (oil palm) single nucleotide polymorphism (SNP) in genomic region adjacent to shatterproof1 (SHELL) shell thickness gene
gatgagcaccatatttccatgccarcaggaaaacaaaagcacgcatctta

SEQ ID NO: 2093 - DNA, 50 bp, Artificial Sequence
  synthetic Elaeis guineensis (oil palm) single nucleotide polymorphism (SNP) in genomic region adjacent to shatterproof1 (SHELL) shell thickness gene
tggacaattcagcacttgcaatccyattagcaagcaagatttcttctcgt

SEQ ID NO: 2094 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcacttgctgcccgattttctaccraccaaatggcatcacttctggctgt

SEQ ID NO: 2095 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaattgacaaaccaaaaagttgatkggagccttccaacatcacaaaatgc

SEQ ID NO: 2096 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttatctggagcacatcacttccacrtggagatagtaggtcttaacagaat

SEQ ID NO: 2097 - DNA, 50 bp, Artificial Sequence
  synthetic Elaeis guineensis (oil palm) single nucleotide polymorphism (SNP) in genomic region adjacent to shatterproof1 (SHELL) shell thickness gene
gccgaacgtagacggacttgacccrctcctgacctaacttggaccttggc

SEQ ID NO: 2098 - DNA, 50 bp, Artificial Sequence
  synthetic Elaeis guineensis (oil palm) single nucleotide polymorphism (SNP) in genomic region adjacent to shatterproof1 (SHELL) shell thickness gene
ataccgcgacaatgattggataagsatgccaagtgggccgaacgtagacg

SEQ ID NO: 2099 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctgttcttcctcgtcggagtcagkgtcttcttcatctttcccatcgccg

SEQ ID NO: 2100 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatgatttcaatgagatacatttgktgataccacaatgtaggaatgtgga

SEQ ID NO: 2101 - DNA, 50 bp, Artificial Sequence
  synthetic Elaeis guineensis (oil palm) single nucleotide polymorphism (SNP) in genomic region adjacent to shatterproof1 (SHELL) shell thickness gene
acaccccaattggaaggagaaggtmttgatcttctgcaccatttcgagag

SEQ ID NO: 2102 - DNA, 50 bp, Artificial Sequence
  synthetic Elaeis guineensis (oil palm) single nucleotide polymorphism (SNP) in genomic region adjacent to shatterproof1 (SHELL) shell thickness gene
aggtccattaattttccatgacatkatttttttttcccgaaaaatgatat

SEQ ID NO: 2103 - DNA, 50 bp, Artificial Sequence
  synthetic Elaeis guineensis (oil palm) single nucleotide polymorphism (SNP) in genomic region adjacent to shatterproof1 (SHELL) shell thickness gene
attttccatgacatgattttttttycccgaaaaatgatatcctagttatt

SEQ ID NO: 2104 - DNA, 50 bp, Artificial Sequence
  synthetic Elaeis guineensis (oil palm) single nucleotide polymorphism (SNP) in genomic region adjacent to shatterproof1 (SHELL) shell thickness gene
cgagtcatttcatagtttctggatkatctaactgttgttattctcgaatt

SEQ ID NO: 2105 - DNA, 50 bp, Artificial Sequence
  synthetic Elaeis guineensis (oil palm) single nucleotide polymorphism (SNP) in genomic region adjacent to shatterproof1 (SHELL) shell thickness gene
gagtcatttcatagtttctggatgwtctaactgttgttattctcgaatta

SEQ ID NO: 2106 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcatagtttctggatgatctaactkttgttattctcgaattaggttaaac

SEQ ID NO: 2107 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcattttaacagctaaccaactttyaaattacaaacttattctttcaaac

SEQ ID NO: 2108 - DNA, 50 bp, Artificial Sequence
  synthetic Elaeis guineensis (oil palm) single nucleotide polymorphism (SNP) in genomic region adjacent to shatterproof1 (SHELL) shell thickness gene
atatatgactttctcagcagaccckcaccataattttcatgctgcttctt

SEQ ID NO: 2109 - DNA, 50 bp, Artificial Sequence
  synthetic Elaeis guineensis (oil palm) single nucleotide polymorphism (SNP) in genomic region adjacent to shatterproof1 (SHELL) shell thickness gene
actccaaaattcgttctccttggcrgggtagtttgttgccattacgtgta

SEQ ID NO: 2110 - DNA, 50 bp, Artificial Sequence
  synthetic Elaeis guineensis (oil palm) single nucleotide polymorphism (SNP) in genomic region adjacent to shatterproof1 (SHELL) shell thickness gene
agttgtttttcagcttatatcaatkagcaattttcctccaacatattaag

SEQ ID NO: 2111 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttaatgtatttacttacagtaagcwcgtcacaaaaaaccagggtttcata

SEQ ID NO: 2112 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtaagctcgtcacaaaaaaccaggktttcatatatgtagagaaaagtgta

SEQ ID NO: 2113 - DNA, 50 bp, Artificial Sequence
  synthetic Elaeis guineensis (oil palm) single nucleotide polymorphism (SNP) in genomic region adjacent to shatterproof1 (SHELL) shell thickness gene
cagggtttcatatatgtagagaaawgtgtacatacaattcatgggcatgc

SEQ ID NO: 2114 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgcatacaaagtaattgaatacatwtgtggacagtatactggaggaaaca

SEQ ID NO: 2115 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttctcaatcctcaatggcaattgcygcagatgaggggtaattacctgtat

SEQ ID NO: 2116 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaaataggcaactcaatagatgttyttgcaagcatgttgtaaacatcgca

SEQ ID NO: 2117 - DNA, 50 bp, Artificial Sequence
  synthetic Elaeis guineensis (oil palm) single nucleotide polymorphism (SNP) in genomic region adjacent to shatterproof1 (SHELL) shell thickness gene
atttattgaaaactgcgacctttgygagatatatgggaaaaaataaggag

SEQ ID NO: 2118 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttattgaaaactgcgacctttgcragatatatgggaaaaaataaggagg

SEQ ID NO: 2119 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagctggcgcgcaatagaaattgcrgctcaaatcggcagttgattgtaga

SEQ ID NO: 2120 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgtgtgccaatcatgggcaagagcyaagttgatgcatcctaagataatgg

SEQ ID NO: 2121 - DNA, 50 bp, Artificial Sequence
  synthetic Elaeis guineensis (oil palm) single nucleotide polymorphism (SNP) in genomic region adjacent to shatterproof1 (SHELL) shell thickness gene
atgggcaagagctaagttgatgcaycctaagataatggctgagtcaagat

SEQ ID NO: 2122 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgataaaaaaagtagaaaggtcatrttgcaggttggatcagaaggtgaga

SEQ ID NO: 2123 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttgcatcacaaaaatgattttgtayttcaattatatggaggttatggatg

SEQ ID NO: 2124 - DNA, 50 bp, Artificial Sequence
  synthetic Elaeis guineensis (oil palm) single nucleotide polymorphism (SNP) in genomic region adjacent to shatterproof1 (SHELL) shell thickness gene
taatccatattcaggacagtgaaakaacaaaaaagggagggcctttatgg

SEQ ID NO: 2125 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttaatctgttcaaatatttttttcmatgaaattttgttacttttaactct

SEQ ID NO: 2126 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttttcaatgaaattttgttacttytaactcttttcttattatgtgctat

SEQ ID NO: 2127 - DNA, 50 bp, Artificial Sequence
  synthetic Elaeis guineensis (oil palm) single nucleotide polymorphism (SNP) in genomic region adjacent to shatterproof1 (SHELL) shell thickness gene
tacttctgtgaaatttgacaggagrttgcggaaactgcattcaggaatat

SEQ ID NO: 2128 - DNA, 50 bp, Artificial Sequence
  synthetic Elaeis guineensis (oil palm) single nucleotide polymorphism (SNP) in genomic region adjacent to shatterproof1 (SHELL) shell thickness gene
agggaagattatggagcatttaatrtgtagaagcctaattcgagctttac

SEQ ID NO: 2129 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgtatgacaaaaatgtcaatggccwctaaaagaataagcaacaagctctt

SEQ ID NO: 2130 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatatctgtatgatagcttttccaygcaactgtacaggtctatcagtata

SEQ ID NO: 2131 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcttcaatgattgctactattacasttagtttggtgtcattatagaactg

SEQ ID NO: 2132 - DNA, 50 bp, Artificial Sequence
  synthetic Elaeis guineensis (oil palm) single nucleotide polymorphism (SNP) in genomic region adjacent to shatterproof1 (SHELL) shell thickness gene
agtttttgaacacatgcaacttaaygatgaccaggtacgaacagcttata

SEQ ID NO: 2133 - DNA, 50 bp, Artificial Sequence
  synthetic Elaeis guineensis (oil palm) single nucleotide polymorphism (SNP) in genomic region adjacent to shatterproof1 (SHELL) shell thickness gene
atattcattttttttcttaaaaaaraatacattgcttgctgttgatggca

SEQ ID NO: 2134 - DNA, 50 bp, Artificial Sequence
  synthetic Elaeis guineensis (oil palm) single nucleotide polymorphism (SNP) in genomic region adjacent to shatterproof1 (SHELL) shell thickness gene
cactttcacaggtttgatgccataytgtccaagacatttagagattgttt

SEQ ID NO: 2135 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtccaagacatttagagattgtttrgatgtctgggcccaaaatcccatga

SEQ ID NO: 2136 - DNA, 50 bp, Artificial Sequence
  synthetic Elaeis guineensis (oil palm) single nucleotide polymorphism (SNP) in genomic region adjacent to shatterproof1 (SHELL) shell thickness gene
taggcttgtattcacaaatatctcyctatgagattcgggctggcccactc

SEQ ID NO: 2137 - DNA, 50 bp, Artificial Sequence
  synthetic Elaeis guineensis (oil palm) single nucleotide polymorphism (SNP) in genomic region adjacent to shatterproof1 (SHELL) shell thickness gene
tattatttatccccaatcctaaggyggcattgtttcttctcagattcctt

SEQ ID NO: 2138 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgatgcaaattctgcccacactgaygtgcggtcgtttgtttctaatgggg

SEQ ID NO: 2139 - DNA, 50 bp, Artificial Sequence
  synthetic Elaeis guineensis (oil palm) single nucleotide polymorphism (SNP) in genomic region adjacent to shatterproof1 (SHELL) shell thickness gene
gggattatgtacattctgatgcagyacaaggactttaatgttgtcatatc

SEQ ID NO: 2140 - DNA, 50 bp, Artificial Sequence
  synthetic Elaeis guineensis (oil palm) single nucleotide polymorphism (SNP) in genomic region adjacent to shatterproof1 (SHELL) shell thickness gene
acaaggactttaatgttgtcatatygtctgcaagaaaaaggattatgtac

SEQ ID NO: 2141 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtatcattccaaccatatcatcttycgtatcaaaaaaaatctctacttct

SEQ ID NO: 2142 - DNA, 50 bp, Artificial Sequence
  synthetic Elaeis guineensis (oil palm) single nucleotide polymorphism (SNP) in genomic region adjacent to shatterproof1 (SHELL) shell thickness gene
agtccaaatcttatatgtcgtcaaraaatcttttgtaataatatgttgtt

SEQ ID NO: 2143 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttgtaataatatgttgtttcactayatgtcggtcttcaagaaaacgattt

SEQ ID NO: 2144 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgtctgattaacatatgcaaagtcyaaaaatttattgaccccctcaatgt

SEQ ID NO: 2145 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccctcaatgtatgtaggtgaagtcytttctcgcaaatcaatccaactttt

SEQ ID NO: 2146 - DNA, 50 bp, Artificial Sequence
  synthetic Elaeis guineensis (oil palm) single nucleotide polymorphism (SNP) in genomic region adjacent to shatterproof1 (SHELL) shell thickness gene
acttttatccatagtagaggccaaygtgaagaagggtccttggtctcctg

SEQ ID NO: 2147 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcctgaggaggactccaagcttaargagttcatagagaaatatgggactg

SEQ ID NO: 2148 - DNA, 50 bp, Artificial Sequence
  synthetic Elaeis guineensis (oil palm) single nucleotide polymorphism (SNP) in genomic region adjacent to shatterproof1 (SHELL) shell thickness gene
actggtggcaattggattgccctcyctcacaaggttggtaagagagtgat

SEQ ID NO: 2149 - DNA, 50 bp, Artificial Sequence
  synthetic Elaeis guineensis (oil palm) single nucleotide polymorphism (SNP) in genomic region adjacent to shatterproof1 (SHELL) shell thickness gene
attggattgccctctctcacaaggytggtaagagagtgattgagatcctt

SEQ ID NO: 2150 - DNA, 50 bp, Artificial Sequence
  synthetic Elaeis guineensis (oil palm) single nucleotide polymorphism (SNP) in genomic region adjacent to shatterproof1 (SHELL) shell thickness gene
cttctctacctgtttaagagggaayagacatgatcttcttttaataggag

SEQ ID NO: 2151 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctacctgtttaagagggaacagacrtgatcttcttttaataggagagaga

SEQ ID NO: 2152 - DNA, 50 bp, Artificial Sequence
  synthetic Elaeis guineensis (oil palm) single nucleotide polymorphism (SNP) in genomic region adjacent to shatterproof1 (SHELL) shell thickness gene
acagacatgatcttcttttaatagsagagagagatttggtgtcattatgt

SEQ ID NO: 2153 - DNA, 50 bp, Artificial Sequence
  synthetic Elaeis guineensis (oil palm) single nucleotide polymorphism (SNP) in genomic region adjacent to shatterproof1 (SHELL) shell thickness gene
cctgaggcctaacataaagcatggrgagttctcagatgacgaggacagga

SEQ ID NO: 2154 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaagcatggagagttctcagatgaygaggacaggataatatgcagcctct

SEQ ID NO: 2155 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatgcagcctctttgctagtatcgraagcaggtgagagacagcctcttaa

SEQ ID NO: 2156 - DNA, 50 bp, Artificial Sequence
  synthetic Elaeis guineensis (oil palm) single nucleotide polymorphism (SNP) in genomic region adjacent to shatterproof1 (SHELL) shell thickness gene
acagcctcttaatacaatccagttytttccaaactctgtctccctcatcg

SEQ ID NO: 2157 - DNA, 50 bp, Artificial Sequence
  synthetic Elaeis guineensis (oil palm) single nucleotide polymorphism (SNP) in genomic region adjacent to shatterproof1 (SHELL) shell thickness gene
gataacaaaaaatcaattagatatrtctttttttgaggctgtaaaacagc

SEQ ID NO: 2158 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagggttaaacagagatcaagactrgaagatggaacaaactatatattcc

SEQ ID NO: 2159 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcatttgttctctctattcggttgrcatcgaagagggagagatcgagaag

SEQ ID NO: 2160 - DNA, 50 bp, Artificial Sequence
  synthetic Elaeis guineensis (oil palm) single nucleotide polymorphism (SNP) in genomic region adjacent to shatterproof1 (SHELL) shell thickness gene
ataaattatttaccacgatccactrtcgtggtaaaaatcgtagattattt

SEQ ID NO: 2161 - DNA, 50 bp, Artificial Sequence
  synthetic Elaeis guineensis (oil palm) single nucleotide polymorphism (SNP) in genomic region adjacent to shatterproof1 (SHELL) shell thickness gene
gatgataattaagggattcgctaamctttcttaatccacttgattgaaaa

SEQ ID NO: 2162 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaatagtgctaccataatggcatgmtggtccctgtgatgaaaggaataga

SEQ ID NO: 2163 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggaaggtgtcaacaaaacaagtgcwtgcatctagtcattttacacatacc

SEQ ID NO: 2164 - DNA, 50 bp, Artificial Sequence
  synthetic Elaeis guineensis (oil palm) single nucleotide polymorphism (SNP) in genomic region adjacent to shatterproof1 (SHELL) shell thickness gene
attttacacataccaaattaggatkaacaaattaatttattagttggcgt

SEQ ID NO: 2165 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttacacataccaaattaggattaamaaattaatttattagttggcgtact

SEQ ID NO: 2166 - DNA, 50 bp, Artificial Sequence
  synthetic Elaeis guineensis (oil palm) single nucleotide polymorphism (SNP) in genomic region adjacent to shatterproof1 (SHELL) shell thickness gene
taaatcgatctggaacaaaaatttygaaatatatattcagactaaggaaa

SEQ ID NO: 2167 - DNA, 50 bp, Artificial Sequence
  synthetic Elaeis guineensis (oil palm) single nucleotide polymorphism (SNP) in genomic region adjacent to shatterproof1 (SHELL) shell thickness gene
ataaaatttctttatcactttacarataactgcaatgccaattaccaata

SEQ ID NO: 2168 - DNA, 50 bp, Artificial Sequence
  synthetic Elaeis guineensis (oil palm) single nucleotide polymorphism (SNP) in genomic region adjacent to shatterproof1 (SHELL) shell thickness gene
agtattttttatatcatcctcacakgcatattcccaccatatatgagata

SEQ ID NO: 2169 - DNA, 50 bp, Artificial Sequence
  synthetic Elaeis guineensis (oil palm) single nucleotide polymorphism (SNP) in genomic region adjacent to shatterproof1 (SHELL) shell thickness gene
cctcacatgcatattcccaccatawatgagatataaatacatttacaaaa

SEQ ID NO: 2170 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcagaggttcgactctgagagcaayttccatgccaacggccacaagttgc

SEQ ID NO: 2171 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagcttgaaggcttccatgaagacsacaagagacataggcggtatcggtc

SEQ ID NO: 2172 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgtagatagaactggtttttagatwtagtttgtgatgcaagtctttatgt

SEQ ID NO: 2173 - DNA, 50 bp, Artificial Sequence
  synthetic Elaeis guineensis (oil palm) single nucleotide polymorphism (SNP) in genomic region adjacent to shatterproof1 (SHELL) shell thickness gene
attaagtgttccttaatttatcctytattgaaagagaaggtggctgccca

SEQ ID NO: 2174 - DNA, 50 bp, Artificial Sequence
  synthetic Elaeis guineensis (oil palm) single nucleotide polymorphism (SNP) in genomic region adjacent to shatterproof1 (SHELL) shell thickness gene
tattgaaagagaaggtggctgcccwgccagtctctgtgtctgaattgtag

SEQ ID NO: 2175 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggagctgcacaagtaattttcacakagtgctatgtgcacatatttgttca

SEQ ID NO: 2176 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctctgatttattgaccataaccaytaaatcggtagttcagggtattgtg

SEQ ID NO: 2177 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaggtggataattggaaatatatcygagctttgcttaattttcttctcat

SEQ ID NO: 2178 - DNA, 50 bp, Artificial Sequence
  synthetic Elaeis guineensis (oil palm) single nucleotide polymorphism (SNP) in genomic region adjacent to shatterproof1 (SHELL) shell thickness gene
cttaataaagcatctcattgaaaarcatatttcttagtatataatctatc

SEQ ID NO: 2179 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggcagatcttggatatttatacaaractaatcaatccaaataatatcttc

SEQ ID NO: 2180 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgagaatctcagagcttaaatgggrgagtatgtgaggactgtgcaggtat

SEQ ID NO: 2181 - DNA, 50 bp, Artificial Sequence
  synthetic Elaeis guineensis (oil palm) single nucleotide polymorphism (SNP) in genomic region adjacent to shatterproof1 (SHELL) shell thickness gene
tccaacaagaagttctatcttataygattgaaaattggagaaactaaata

SEQ ID NO: 2182 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagaagttctatcttatatgattgraaattggagaaactaaatagcatga

SEQ ID NO: 2183 - DNA, 50 bp, Artificial Sequence
  synthetic Elaeis guineensis (oil palm) single nucleotide polymorphism (SNP) in genomic region adjacent to shatterproof1 (SHELL) shell thickness gene
attccctaaaatctacccccaaccrtcataactattttaacatattctaa

SEQ ID NO: 2184 - DNA, 50 bp, Artificial Sequence
  synthetic Elaeis guineensis (oil palm) single nucleotide polymorphism (SNP) in genomic region adjacent to shatterproof1 (SHELL) shell thickness gene
attcaatggtataattactatgtcraattatattatgttaaatagaaaac

SEQ ID NO: 2185 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttaatatctagtacattatgcattygattttattggatagactaactacc

SEQ ID NO: 2186 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttaaataggctggcccaaatatgaytaaacaatgaatatagtttaggccc

SEQ ID NO: 2187 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtcggcatgcaactttgagtggaawgagattttcaccatataatcaccat

SEQ ID NO: 2188 - DNA, 50 bp, Artificial Sequence
  synthetic Elaeis guineensis (oil palm) single nucleotide polymorphism (SNP) in genomic region adjacent to shatterproof1 (SHELL) shell thickness gene
agagattttcaccatataatcaccwtattactgcaactaatttttagcac

SEQ ID NO: 2189 - DNA, 50 bp, Artificial Sequence
  synthetic Elaeis guineensis (oil palm) single nucleotide polymorphism (SNP) in genomic region adjacent to shatterproof1 (SHELL) shell thickness gene
taatcaccatattactgcaactaayttttagcacatgccacctttaattc

SEQ ID NO: 2190 - DNA, 50 bp, Artificial Sequence
  synthetic Elaeis guineensis (oil palm) single nucleotide polymorphism (SNP) in genomic region adjacent to shatterproof1 (SHELL) shell thickness gene
aattattttatttgcaacaaacctyatcgcagcttgattttctcaatttt

SEQ ID NO: 2191 - DNA, 50 bp, Artificial Sequence
  synthetic Elaeis guineensis (oil palm) single nucleotide polymorphism (SNP) in genomic region adjacent to shatterproof1 (SHELL) shell thickness gene
atcaaaaacacgggcagcatgctcmcggtcggcactaataaagcagcagc

SEQ ID NO: 2192 - DNA, 50 bp, Artificial Sequence
  synthetic Elaeis guineensis (oil palm) single nucleotide polymorphism (SNP) in genomic region adjacent to shatterproof1 (SHELL) shell thickness gene
aacacgggcagcatgctcacggtcrgcactaataaagcagcagcaaagga

SEQ ID NO: 2193 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttttctcagctttgttcgcttttwggaaccctattcgcatcaaaaattc

SEQ ID NO: 2194 - DNA, 50 bp, Artificial Sequence
  synthetic Elaeis guineensis (oil palm) single nucleotide polymorphism (SNP) in genomic region adjacent to shatterproof1 (SHELL) shell thickness gene
attaattgtgcacatgtacaaggayggtgtaattgcgcacaagagtgtgt

SEQ ID NO: 2195 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcatagtctttcgcacttttttttwaaaaaaataaataaataaacatagg

SEQ ID NO: 2196 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttagcttcccgatacggtaccgatrgttgtttgttattccacgaaatcta

SEQ ID NO: 2197 - DNA, 50 bp, Artificial Sequence
  synthetic Elaeis guineensis (oil palm) single nucleotide polymorphism (SNP) in genomic region adjacent to shatterproof1 (SHELL) shell thickness gene
acggtaccgatagttgtttgttatyccacgaaatctactcgaatggttac

SEQ ID NO: 2198 - DNA, 50 bp, Artificial Sequence
  synthetic Elaeis guineensis (oil palm) single nucleotide polymorphism (SNP) in genomic region adjacent to shatterproof1 (SHELL) shell thickness gene
atcaaccaggaacttgcttgcttcrtgatatcattgccaaaattttgtga

SEQ ID NO: 2199 - DNA, 50 bp, Artificial Sequence
  synthetic Elaeis guineensis (oil palm) single nucleotide polymorphism (SNP) in genomic region adjacent to shatterproof1 (SHELL) shell thickness gene
cgccaaccagcccttttggttgagsataatctgacataaaaaatatatca

SEQ ID NO: 2200 - DNA, 50 bp, Artificial Sequence
  synthetic Elaeis guineensis (oil palm) single nucleotide polymorphism (SNP) in genomic region adjacent to shatterproof1 (SHELL) shell thickness gene
atatttatcaataaatattaattaytaataaataattaataaatagaggt

SEQ ID NO: 2201 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttaataaataattaataaatagagrttagttaaaataaatctaacatagg

SEQ ID NO: 2202 - DNA, 50 bp, Artificial Sequence
  synthetic Elaeis guineensis (oil palm) single nucleotide polymorphism (SNP) in genomic region adjacent to shatterproof1 (SHELL) shell thickness gene
attaatttaagatatttattaattyatttaaatatattttaatatttgaa

SEQ ID NO: 2203 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatttaagatatttattaatttatytaaatatattttaatatttgaaata

SEQ ID NO: 2204 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttctgatgctattttatggagtgmtttttctatcaaccatacacaataa

SEQ ID NO: 2205 - DNA, 50 bp, Artificial Sequence
  synthetic Elaeis guineensis (oil palm) single nucleotide polymorphism (SNP) in genomic region adjacent to shatterproof1 (SHELL) shell thickness gene
aacattgcaagtacctcccactccmatacctaaatctatttagccaattc

SEQ ID NO: 2206 - DNA, 50 bp, Artificial Sequence
  synthetic Elaeis guineensis (oil palm) single nucleotide polymorphism (SNP) in genomic region adjacent to shatterproof1 (SHELL) shell thickness gene
caaatatttatgtaaaatatatccmctcaaaaagcataagaaacaatttt

SEQ ID NO: 2207 - DNA, 50 bp, Artificial Sequence
  synthetic Elaeis guineensis (oil palm) single nucleotide polymorphism (SNP) in genomic region adjacent to shatterproof1 (SHELL) shell thickness gene
atgaatggacttggaggaagaaaargatgagaagaaaaaatgaataagga

SEQ ID NO: 2208 - DNA, 50 bp, Artificial Sequence
  synthetic Elaeis guineensis (oil palm) single nucleotide polymorphism (SNP) in genomic region adjacent to shatterproof1 (SHELL) shell thickness gene
gagaatgatcatggataaggaatakgttagagaagaagaagaaggataag

SEQ ID NO: 2209 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggcttgaagaaaaaaaatgaggagrtaaagtgcatgggaagaaaggagag

SEQ ID NO: 2210 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttaaagtagtaaaaattgtcagctrgccaatcatagttaacaattaaact

SEQ ID NO: 2211 - DNA, 50 bp, Artificial Sequence
  synthetic Elaeis guineensis (oil palm) single nucleotide polymorphism (SNP) in genomic region adjacent to shatterproof1 (SHELL) shell thickness gene
cactaggctcctaattactaagtgrtcatatgtatttaatcttattttta

SEQ ID NO: 2212 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccacatacagtcgctaataatctcrccgtcgctaattccgtcgtaacagt

SEQ ID NO: 2213 - DNA, 50 bp, Artificial Sequence
  synthetic Elaeis guineensis (oil palm) single nucleotide polymorphism (SNP) in genomic region adjacent to shatterproof1 (SHELL) shell thickness gene
agtttaccacatgacatgtgtaccrtagaactatgtgagctggctacata

SEQ ID NO: 2214 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctcttcaatatctatttagtttgratcattatcaaaaaaaattaagaag

SEQ ID NO: 2215 - DNA, 50 bp, Artificial Sequence
  synthetic Elaeis guineensis (oil palm) single nucleotide polymorphism (SNP) in genomic region adjacent to shatterproof1 (SHELL) shell thickness gene
catcgacatccgtcagttttaagayatcatatgagaagaagtaaaagagg

SEQ ID NO: 2216 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaattagatttgacttaatttgagrttaattagattttataattcaagta

SEQ ID NO: 2217 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttgagttttataattcaagtagggyttagattcgaagtctaattgaatta

SEQ ID NO: 2218 - DNA, 50 bp, Artificial Sequence
  synthetic Elaeis guineensis (oil palm) single nucleotide polymorphism (SNP) in genomic region adjacent to shatterproof1 (SHELL) shell thickness gene
caaagttatgaactgaacaaagaawtaaatattatatgcagagagatgaa

SEQ ID NO: 2219 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttaggtcattaagaatatatattakgatgttttcctttcacctgatatca

SEQ ID NO: 2220 - DNA, 50 bp, Artificial Sequence
  synthetic Elaeis guineensis (oil palm) single nucleotide polymorphism (SNP) in genomic region adjacent to shatterproof1 (SHELL) shell thickness gene
atgttttcctttcacctgatatcawtttttggaatgatcaaattgtctga

SEQ ID NO: 2221 - DNA, 50 bp, Artificial Sequence
  synthetic Elaeis guineensis (oil palm) single nucleotide polymorphism (SNP) in genomic region adjacent to shatterproof1 (SHELL) shell thickness gene
gatcaaattgtctgatttgattatsctagacaaggcaatagcatatttat

SEQ ID NO: 2222 - DNA, 50 bp, Artificial Sequence
  synthetic Elaeis guineensis (oil palm) single nucleotide polymorphism (SNP) in genomic region adjacent to shatterproof1 (SHELL) shell thickness gene
atataaaatatctaaaataatatcrtattattttattttctggtaatatt

SEQ ID NO: 2223 - DNA, 50 bp, Artificial Sequence
  synthetic Elaeis guineensis (oil palm) single nucleotide polymorphism (SNP) in genomic region adjacent to shatterproof1 (SHELL) shell thickness gene
attagtttaaaatatattaaagtcrtaacaattattggtgtggcgctatt

SEQ ID NO: 2224 - DNA, 50 bp, Artificial Sequence
  synthetic Elaeis guineensis (oil palm) single nucleotide polymorphism (SNP) in genomic region adjacent to shatterproof1 (SHELL) shell thickness gene
atataaaatacattattattgaaakattgataaaaatatggtattatata

SEQ ID NO: 2225 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtataatagtaaaaaatatattttycttatatatacatatagtaaaagct

SEQ ID NO: 2226 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttttattattactcaaccatatawaccactaacaagaaaaatgatatcc

SEQ ID NO: 2227 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgagccaaataaacataataatggsttagaaagggcatctatatccattt

SEQ ID NO: 2228 - DNA, 50 bp, Artificial Sequence
  synthetic Elaeis guineensis (oil palm) single nucleotide polymorphism (SNP) in genomic region adjacent to shatterproof1 (SHELL) shell thickness gene
acctttgttggtcttgagttgtctrtccttagctcatccttggttggata

SEQ ID NO: 2229 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgctattgtctatcaatatttttgyccagctatcttagccacatcattgc

SEQ ID NO: 2230 - DNA, 50 bp, Artificial Sequence
  synthetic Elaeis guineensis (oil palm) single nucleotide polymorphism (SNP) in genomic region adjacent to shatterproof1 (SHELL) shell thickness gene
caaacaaaaattggacagacaaacrgtccaaattgagtttcaaaaaaatg

SEQ ID NO: 2231 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcccaatttgcccacttgctagcgrggggggcaatttctgacatggcaat

SEQ ID NO: 2232 - DNA, 50 bp, Artificial Sequence
  synthetic Elaeis guineensis (oil palm) single nucleotide polymorphism (SNP) in genomic region adjacent to shatterproof1 (SHELL) shell thickness gene
atgtatacattcgaaatggttgtgkgtttagaacttgccatgcataattc

SEQ ID NO: 2233 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtgggtttagaacttgccatgcatwattcatggtcaagccaaaatggggg

SEQ ID NO: 2234 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaatgggggaaataaaggaaaaarttaaggaaaaggcgaagtgagtggc

SEQ ID NO: 2235 - DNA, 50 bp, Artificial Sequence
  synthetic Elaeis guineensis (oil palm) single nucleotide polymorphism (SNP) in genomic region adjacent to shatterproof1 (SHELL) shell thickness gene
gggaaataaaggaaaaaattaaggraaaggcgaagtgagtggcttgttca

SEQ ID NO: 2236 - DNA, 50 bp, Artificial Sequence
  synthetic Elaeis guineensis (oil palm) single nucleotide polymorphism (SNP) in genomic region adjacent to shatterproof1 (SHELL) shell thickness gene
aggaaaaggcgaagtgagtggcttkttcagaatctgtcatgttttcttct

SEQ ID NO: 2237 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcgaagtgagtggcttgttcagaayctgtcatgttttcttctatacttca

SEQ ID NO: 2238 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctttcagtttccccggacaactatwccttcaatccccttttcctggccct

SEQ ID NO: 2239 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccatataaaataaacgagctgggtrtggtatcattctttgcaactcaatt

SEQ ID NO: 2240 - DNA, 50 bp, Artificial Sequence
  synthetic Elaeis guineensis (oil palm) single nucleotide polymorphism (SNP) in genomic region adjacent to shatterproof1 (SHELL) shell thickness gene
caactcaattataaatagcttaggwatgaattaaagtttttgtttgacta

SEQ ID NO: 2241 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcggaatgaagcccaaggacctcawatttatgtctagatttccacccaac

SEQ ID NO: 2242 - DNA, 50 bp, Artificial Sequence
  synthetic Elaeis guineensis (oil palm) single nucleotide polymorphism (SNP) in genomic region adjacent to shatterproof1 (SHELL) shell thickness gene
caaccgtgaaactaggccacgctartttggggcctggggaatctgaaatt

SEQ ID NO: 2243 - DNA, 50 bp, Artificial Sequence
  synthetic Elaeis guineensis (oil palm) single nucleotide polymorphism (SNP) in genomic region adjacent to shatterproof1 (SHELL) shell thickness gene
tagtggcatgacattgtagctaacwcttttctcaaaaacgggaaaataag

SEQ ID NO: 2244 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggcatgacattgtagctaacacttytctcaaaaacgggaaaataagaaaa

SEQ ID NO: 2245 - DNA, 50 bp, Artificial Sequence
  synthetic Elaeis guineensis (oil palm) single nucleotide polymorphism (SNP) in genomic region adjacent to shatterproof1 (SHELL) shell thickness gene
aataagaattacgaccaatgttttkgataggaaatggagatcgatggtga

SEQ ID NO: 2246 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttagacatatctttaaaaattaatytgaaataaatgctaacttaaaattt

SEQ ID NO: 2247 - DNA, 50 bp, Artificial Sequence
  synthetic Elaeis guineensis (oil palm) single nucleotide polymorphism (SNP) in genomic region adjacent to shatterproof1 (SHELL) shell thickness gene
tccttttacttatggagtttcctaraagtgtagcaatattagacttattt

SEQ ID NO: 2248 - DNA, 50 bp, Artificial Sequence
  synthetic Elaeis guineensis (oil palm) single nucleotide polymorphism (SNP) in genomic region adjacent to shatterproof1 (SHELL) shell thickness gene
cttttacttatggagtttcctaaawgtgtagcaatattagacttattttt

SEQ ID NO: 2249 - DNA, 50 bp, Artificial Sequence
  synthetic Elaeis guineensis (oil palm) single nucleotide polymorphism (SNP) in genomic region adjacent to shatterproof1 (SHELL) shell thickness gene
taaatcagtaaaaaagttattattkaataaattaaaaattaaaaaataat

SEQ ID NO: 2250 - DNA, 50 bp, Artificial Sequence
  synthetic Elaeis guineensis (oil palm) single nucleotide polymorphism (SNP) in genomic region adjacent to shatterproof1 (SHELL) shell thickness gene
atcagtaaaaaagttattattgaakaaattaaaaattaaaaaataataat

SEQ ID NO: 2251 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttttttttttggtacaaacgaacgrtcataccaatctagtgtaagaacat

SEQ ID NO: 2252 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggtcataccaatctagtgtaagaayatttcaaagagtcaaaatacaaaat

SEQ ID NO: 2253 - DNA, 50 bp, Artificial Sequence
  synthetic Elaeis guineensis (oil palm) single nucleotide polymorphism (SNP) in genomic region adjacent to shatterproof1 (SHELL) shell thickness gene
cttcatctcatcctaaattcagtcratgactggagtggagtcaccctcaa

SEQ ID NO: 2254 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggagtcaccctcaatgaagatcttytcagcccacaactcctgtctcgtat

SEQ ID NO: 2255 - DNA, 50 bp, Artificial Sequence
  synthetic Elaeis guineensis (oil palm) single nucleotide polymorphism (SNP) in genomic region adjacent to shatterproof1 (SHELL) shell thickness gene
gacagattcggaggaaggtggctcycaggaaatgaaagaacccttcgagt

SEQ ID NO: 2256 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtgcagcaagagaatcctaaaaacwtgaggcagcaaggctcggaccagca

SEQ ID NO: 2257 - DNA, 50 bp, Artificial Sequence
  synthetic Elaeis guineensis (oil palm) single nucleotide polymorphism (SNP) in genomic region adjacent to shatterproof1 (SHELL) shell thickness gene
taaaaacttgaggcagcaaggctcrgaccagcagtgtcgaagtgacagca

SEQ ID NO: 2258 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggctctttacagtacccattgaatygatataatctcagtatcaaacaaaa

SEQ ID NO: 2259 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctctttacagtacccattgaatcgrtataatctcagtatcaaacaaaagg

SEQ ID NO: 2260 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaggctattgttggacagccaaacytgataagtgacatacaccatcctac

SEQ ID NO: 2261 - DNA, 50 bp, Artificial Sequence
  synthetic Elaeis guineensis (oil palm) single nucleotide polymorphism (SNP) in genomic region adjacent to shatterproof1 (SHELL) shell thickness gene
cccttgccatgctccgatggatcaygtctaagaagggaggaagctaaggg

SEQ ID NO: 2262 - DNA, 50 bp, Artificial Sequence
  synthetic Elaeis guineensis (oil palm) single nucleotide polymorphism (SNP) in genomic region adjacent to shatterproof1 (SHELL) shell thickness gene
tccagcccgcaaactaggtagatarttagaacctccatacctctatcttt

SEQ ID NO: 2263 - DNA, 50 bp, Artificial Sequence
  synthetic Elaeis guineensis (oil palm) single nucleotide polymorphism (SNP) in genomic region adjacent to shatterproof1 (SHELL) shell thickness gene
cttctagagaaaaagcctaaacctrggatgggcaaccattctctaaatcc

SEQ ID NO: 2264 - DNA, 50 bp, Artificial Sequence
  synthetic Elaeis guineensis (oil palm) single nucleotide polymorphism (SNP) in genomic region adjacent to shatterproof1 (SHELL) shell thickness gene
gagccctccaactcctgtcgtcaayagtgatcgaattataaacccacaga

SEQ ID NO: 2265 - DNA, 50 bp, Artificial Sequence
  synthetic Elaeis guineensis (oil palm) single nucleotide polymorphism (SNP) in genomic region adjacent to shatterproof1 (SHELL) shell thickness gene
gagagagaggcaaactagagatccmagcatcctggctcacatcaatcgag

SEQ ID NO: 2266 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcatcctggctcacatcaatcgagrttctgtctccaatcagctacttgat

SEQ ID NO: 2267 - DNA, 50 bp, Artificial Sequence
  synthetic Elaeis guineensis (oil palm) single nucleotide polymorphism (SNP) in genomic region adjacent to shatterproof1 (SHELL) shell thickness gene
agctgtatgtctgaaaatcatagcytctctcctgactagcaaggattgga

SEQ ID NO: 2268 - DNA, 50 bp, Artificial Sequence
  synthetic Elaeis guineensis (oil palm) single nucleotide polymorphism (SNP) in genomic region adjacent to shatterproof1 (SHELL) shell thickness gene
agcaaggattggattctaagacccycatcccgcaccggctgacagaccac

SEQ ID NO: 2269 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaagagagcgttggcttgccagccrtcgaagcgatctcagacttgctgct

SEQ ID NO: 2270 - DNA, 50 bp, Artificial Sequence
  synthetic Elaeis guineensis (oil palm) single nucleotide polymorphism (SNP) in genomic region adjacent to shatterproof1 (SHELL) shell thickness gene
accttgcatttcgaactgaaatctractaatgagcaagcagtcatctgta

SEQ ID NO: 2271 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgcatttcgaactgaaatctgactratgagcaagcagtcatctgtaaaag

SEQ ID NO: 2272 - DNA, 50 bp, Artificial Sequence
  synthetic Elaeis guineensis (oil palm) single nucleotide polymorphism (SNP) in genomic region adjacent to shatterproof1 (SHELL) shell thickness gene
accagagggcctctcgtacctcctyagtagacacagggcgagttagaatc

SEQ ID NO: 2273 - DNA, 50 bp, Artificial Sequence
  synthetic Elaeis guineensis (oil palm) single nucleotide polymorphism (SNP) in genomic region adjacent to shatterproof1 (SHELL) shell thickness gene
tccaacgtgatttaaagaaatacakaatctatctcctaatctcataatac

SEQ ID NO: 2274 - DNA, 50 bp, Artificial Sequence
  synthetic Elaeis guineensis (oil palm) single nucleotide polymorphism (SNP) in genomic region adjacent to shatterproof1 (SHELL) shell thickness gene
agtagcttatgtcaaagctcccttrggtcaagctcttgaaggccccctcc

SEQ ID NO: 2275 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttgaagatatcaccaaccttcagtyggttccatcagatatgcctgcgccg

SEQ ID NO: 2276 - DNA, 50 bp, Artificial Sequence
  synthetic Elaeis guineensis (oil palm) single nucleotide polymorphism (SNP) in genomic region adjacent to shatterproof1 (SHELL) shell thickness gene
atcaccaaccttcagtcggttccaycagatatgcctgcgccgcgcaaact

SEQ ID NO: 2277 - DNA, 50 bp, Artificial Sequence
  synthetic Elaeis guineensis (oil palm) single nucleotide polymorphism (SNP) in genomic region adjacent to shatterproof1 (SHELL) shell thickness gene
cggatcaacatccttcaaacatccytaatcagatctaggatttcggatag

SEQ ID NO: 2278 - DNA, 50 bp, Artificial Sequence
  synthetic Elaeis guineensis (oil palm) single nucleotide polymorphism (SNP) in genomic region adjacent to shatterproof1 (SHELL) shell thickness gene
catccttcaaacatccctaatcagrtctaggatttcggatagaaggtcca

SEQ ID NO: 2279 - DNA, 50 bp, Artificial Sequence
  synthetic Elaeis guineensis (oil palm) single nucleotide polymorphism (SNP) in genomic region adjacent to shatterproof1 (SHELL) shell thickness gene
cagtggtgatgagaagtgggcaacrgttcgaagcaatgctcggaaggtgc

SEQ ID NO: 2280 - DNA, 50 bp, Artificial Sequence
  synthetic Elaeis guineensis (oil palm) single nucleotide polymorphism (SNP) in genomic region adjacent to shatterproof1 (SHELL) shell thickness gene
acgctcgatcaatcctctcccaaaytctagctgtcccaagccagttgttg

SEQ ID NO: 2281 - DNA, 50 bp, Artificial Sequence
  synthetic Elaeis guineensis (oil palm) single nucleotide polymorphism (SNP) in genomic region adjacent to shatterproof1 (SHELL) shell thickness gene
cgctcgatcaatcctctcccaaatyctagctgtcccaagccagttgttgc

SEQ ID NO: 2282 - DNA, 50 bp, Artificial Sequence
  synthetic Elaeis guineensis (oil palm) single nucleotide polymorphism (SNP) in genomic region adjacent to shatterproof1 (SHELL) shell thickness gene
atactatccacatactgcttgccayccatcttctcatgggactccactat

SEQ ID NO: 2283 - DNA, 50 bp, Artificial Sequence
  synthetic Elaeis guineensis (oil palm) single nucleotide polymorphism (SNP) in genomic region adjacent to shatterproof1 (SHELL) shell thickness gene
gccacccatcttctcatgggactcyactatatagttgaaatccctagcga

SEQ ID NO: 2284 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctatagcaccctccgctccctgtayttggtgctcgcatatcctccggaca

SEQ ID NO: 2285 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccggacagaagccaaagaccatcartttgctcagatatgactaacgccac

SEQ ID NO: 2286 - DNA, 50 bp, Artificial Sequence
  synthetic Elaeis guineensis (oil palm) single nucleotide polymorphism (SNP) in genomic region adjacent to shatterproof1 (SHELL) shell thickness gene
actcgacgtctccctgaagccctgrcccagtcctctcgagagccatctcc

SEQ ID NO: 2287 - DNA, 50 bp, Artificial Sequence
  synthetic Elaeis guineensis (oil palm) single nucleotide polymorphism (SNP) in genomic region adjacent to shatterproof1 (SHELL) shell thickness gene
agtttgtatatgagttaaattctgytatactttcatcatgttctgatttt

SEQ ID NO: 2288 - DNA, 50 bp, Artificial Sequence
  synthetic Elaeis guineensis (oil palm) single nucleotide polymorphism (SNP) in genomic region adjacent to shatterproof1 (SHELL) shell thickness gene
cacagtcttgaaaatcatgtatttyacaccaagcctttgttccatattgg

SEQ ID NO: 2289 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttatggttccctcctgggttcttkggcttgcatgtgatttgggctactt

SEQ ID NO: 2290 - DNA, 50 bp, Artificial Sequence
  synthetic Elaeis guineensis (oil palm) single nucleotide polymorphism (SNP) in genomic region adjacent to shatterproof1 (SHELL) shell thickness gene
tggttccctcctgggttcttgggcwtgcatgtgatttgggctacttggac

SEQ ID NO: 2291 - DNA, 50 bp, Artificial Sequence
  synthetic Elaeis guineensis (oil palm) single nucleotide polymorphism (SNP) in genomic region adjacent to shatterproof1 (SHELL) shell thickness gene
catggtttctctggacaatttatawcgaataccaaggcaaatgtatcctt

SEQ ID NO: 2292 - DNA, 50 bp, Artificial Sequence
  synthetic Elaeis guineensis (oil palm) single nucleotide polymorphism (SNP) in genomic region adjacent to shatterproof1 (SHELL) shell thickness gene
tccttctaatgtctcaaatttcagyaaaagtgttaggattgacattacct

SEQ ID NO: 2293 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctatctcacacttaatttaaatgkcatgcacaattcaggcttttgtata

SEQ ID NO: 2294 - DNA, 50 bp, Artificial Sequence
  synthetic Elaeis guineensis (oil palm) single nucleotide polymorphism (SNP) in genomic region adjacent to shatterproof1 (SHELL) shell thickness gene
taatttgttccatcagccccttttkatgtgcttatttttttaagcacctc

SEQ ID NO: 2295 - DNA, 50 bp, Artificial Sequence
  synthetic Elaeis guineensis (oil palm) single nucleotide polymorphism (SNP) in genomic region adjacent to shatterproof1 (SHELL) shell thickness gene
actggactcccattggtaagcaagraaaaaagaaagaattagactacatg

SEQ ID NO: 2296 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaagaaagaattagactacatgcrttgttttccttttgtcaacttgtgg

SEQ ID NO: 2297 - DNA, 50 bp, Artificial Sequence
  synthetic Elaeis guineensis (oil palm) single nucleotide polymorphism (SNP) in genomic region adjacent to shatterproof1 (SHELL) shell thickness gene
aacatgtaagcttggtagagtcatkaatttttctcctggataatctgatc

SEQ ID NO: 2298 - DNA, 50 bp, Artificial Sequence
  synthetic Elaeis guineensis (oil palm) single nucleotide polymorphism (SNP) in genomic region adjacent to shatterproof1 (SHELL) shell thickness gene
taagccagcgactctttccggtctrcaagcacgattggttgggttaagcc

SEQ ID NO: 2299 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcgactctttccggtctgcaagcaygattggttgggttaagccacttttc

SEQ ID NO: 2300 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttaggtcacttcaatctttataagktttcaaaaattgaatcctagaactc

SEQ ID NO: 2301 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctcgtagaaacaaaaatgagcaatyaccttttccggtttctttgtatctg

SEQ ID NO: 2302 - DNA, 50 bp, Artificial Sequence
  synthetic Elaeis guineensis (oil palm) single nucleotide polymorphism (SNP) in genomic region adjacent to shatterproof1 (SHELL) shell thickness gene
acaaaaatgagcaattaccttttcsggtttctttgtatctgcaagtaaca

SEQ ID NO: 2303 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttctttgtatctgcaagtaacattytctcaacattcaacaaatatatgat

SEQ ID NO: 2304 - DNA, 50 bp, Artificial Sequence
  synthetic Elaeis guineensis (oil palm) single nucleotide polymorphism (SNP) in genomic region adjacent to shatterproof1 (SHELL) shell thickness gene
gttttacttggatttgtttcttttmctttctttctctatcaatatggtgc

SEQ ID NO: 2305 - DNA, 50 bp, Artificial Sequence
  synthetic Elaeis guineensis (oil palm) single nucleotide polymorphism (SNP) in genomic region adjacent to shatterproof1 (SHELL) shell thickness gene
tggctgcactgaatttttaggcatratgataaaccaaaattttcaagcct

SEQ ID NO: 2306 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttaaattagacttattgaaaaagawaatatgcatatttctataatacatc

SEQ ID NO: 2307 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggtccagccaatttacttaatcatscttggcttgtgcggaacttgtccta

SEQ ID NO: 2308 - DNA, 50 bp, Artificial Sequence
  synthetic Elaeis guineensis (oil palm) single nucleotide polymorphism (SNP) in genomic region adjacent to shatterproof1 (SHELL) shell thickness gene
atctctcagtagaagagagtaaaakgcttgctcatgagaatgcgaaagac

SEQ ID NO: 2309 - DNA, 50 bp, Artificial Sequence
  synthetic Elaeis guineensis (oil palm) single nucleotide polymorphism (SNP) in genomic region adjacent to shatterproof1 (SHELL) shell thickness gene
gttgagtgttgtcctttcacttgcwtgaatagatatgccaatatctagtg

SEQ ID NO: 2310 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtcctttcacttgcatgaatagatrtgccaatatctagtggcataacaag

SEQ ID NO: 2311 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatgccaatatctagtggcataacragaacaatgttgttattgaggtcat

SEQ ID NO: 2312 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctgtttcatgttttttcttagtttmttagatttcactctggagcattaat

SEQ ID NO: 2313 - DNA, 50 bp, Artificial Sequence
  synthetic Elaeis guineensis (oil palm) single nucleotide polymorphism (SNP) in genomic region adjacent to shatterproof1 (SHELL) shell thickness gene
cacttaaattccatttgcatagtgratgttgtttagttattcctaccatt

SEQ ID NO: 2314 - DNA, 50 bp, Artificial Sequence
  synthetic Elaeis guineensis (oil palm) single nucleotide polymorphism (SNP) in genomic region adjacent to shatterproof1 (SHELL) shell thickness gene
actttcatgtgacactgaatttaaytctcattcaatggattaatctcctg

SEQ ID NO: 2315 - DNA, 50 bp, Artificial Sequence
  synthetic Elaeis guineensis (oil palm) single nucleotide polymorphism (SNP) in genomic region adjacent to shatterproof1 (SHELL) shell thickness gene
gttgcaaagtgcatcacgtttaatwaggtaaatgctagagtcatttgaga

SEQ ID NO: 2316 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcatcacgtttaataaggtaaatgytagagtcatttgagataaattccaa

SEQ ID NO: 2317 - DNA, 50 bp, Artificial Sequence
  synthetic Elaeis guineensis (oil palm) single nucleotide polymorphism (SNP) in genomic region adjacent to shatterproof1 (SHELL) shell thickness gene
gttttcttatgtcttgcatttgtgyaacttaggttgtgggaatatttggc

SEQ ID NO: 2318 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtgggaatatttggcttcacacaakaagatcatattggaaaaattagctt

SEQ ID NO: 2319 - DNA, 50 bp, Artificial Sequence
  synthetic Elaeis guineensis (oil palm) single nucleotide polymorphism (SNP) in genomic region adjacent to shatterproof1 (SHELL) shell thickness gene
agttattttagctttctagtctatrtgtacaaggcttcgtgtgtgtgtcc

SEQ ID NO: 2320 - DNA, 50 bp, Artificial Sequence
  synthetic Elaeis guineensis (oil palm) single nucleotide polymorphism (SNP) in genomic region adjacent to shatterproof1 (SHELL) shell thickness gene
cctagttcatttccacatctcttcyctggaaaggaccagcttcgttgctt

SEQ ID NO: 2321 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcatatgctctatagtaaagattgrcatatccccactaattaggttattg

SEQ ID NO: 2322 - DNA, 50 bp, Artificial Sequence
  synthetic Elaeis guineensis (oil palm) single nucleotide polymorphism (SNP) in genomic region adjacent to shatterproof1 (SHELL) shell thickness gene
acaacacatcttgtcaagcagtgcmgtgtcatttcatccagtattaaaac

SEQ ID NO: 2323 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtgccgtgtcatttcatccagtatyaaaacattgaattgtcaggatactt

SEQ ID NO: 2324 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgtcaggatacttcaaatttcctcrttttcaaagtgtccacttgtcgctt

SEQ ID NO: 2325 - DNA, 50 bp, Artificial Sequence
  synthetic Elaeis guineensis (oil palm) single nucleotide polymorphism (SNP) in genomic region adjacent to shatterproof1 (SHELL) shell thickness gene
tattaactgtgcatgaaaattttgrcacaagtatccatgttatctgttga

SEQ ID NO: 2326 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctggaacttctttgcttgtccatktgtatgataagcaaccaggagttgt

SEQ ID NO: 2327 - DNA, 50 bp, Artificial Sequence
  synthetic Elaeis guineensis (oil palm) single nucleotide polymorphism (SNP) in genomic region adjacent to shatterproof1 (SHELL) shell thickness gene
atcacctgtatctaatagttgatcrttatagcttgacttcttgatccact

SEQ ID NO: 2328 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcctttgtgggaactattagatgcwccatccatcatatatgcataatttg

SEQ ID NO: 2329 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttgttggtgttccatggttccaccrgtatgtgctttttaaaagcattctt

SEQ ID NO: 2330 - DNA, 50 bp, Artificial Sequence
  synthetic Elaeis guineensis (oil palm) single nucleotide polymorphism (SNP) in genomic region adjacent to shatterproof1 (SHELL) shell thickness gene
atttaaggcattgtgagccatactrgtagcaaactgaaatggtttagacg

SEQ ID NO: 2331 - DNA, 50 bp, Artificial Sequence
  synthetic Elaeis guineensis (oil palm) single nucleotide polymorphism (SNP) in genomic region adjacent to shatterproof1 (SHELL) shell thickness gene
agaagaggggagaggaagataggaygacgctgttggaggccagcggtggc

SEQ ID NO: 2332 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggggagaggaagataggacgacgcygttggaggccagcggtggcccgtcg

SEQ ID NO: 2333 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaggccagcggtggcccgtcgaggytggccggagggccacgttggcctct

SEQ ID NO: 2334 - DNA, 50 bp, Artificial Sequence
  synthetic Elaeis guineensis (oil palm) single nucleotide polymorphism (SNP) in genomic region adjacent to shatterproof1 (SHELL) shell thickness gene
agggccacgttggcctctgcagctygatgtcgcctgatagggcatttaaa

SEQ ID NO: 2335 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggagggatgtgcagctggcggagakgttgtcagagggcaccagatgactg

SEQ ID NO: 2336 - DNA, 50 bp, Artificial Sequence
  synthetic Elaeis guineensis (oil palm) single nucleotide polymorphism (SNP) in genomic region adjacent to shatterproof1 (SHELL) shell thickness gene
gatgaaatagggacgatcgcccttrtttcatgtccgcggtaccataggcg

SEQ ID NO: 2337 - DNA, 50 bp, Artificial Sequence
  synthetic Elaeis guineensis (oil palm) single nucleotide polymorphism (SNP) in genomic region adjacent to shatterproof1 (SHELL) shell thickness gene
gctggccagcacaggtcccgatttygattccggttctgccttccttgttt

SEQ ID NO: 2338 - DNA, 50 bp, Artificial Sequence
  synthetic Elaeis guineensis (oil palm) single nucleotide polymorphism (SNP) in genomic region adjacent to shatterproof1 (SHELL) shell thickness gene
atctacttttacatgattgctggtsgatgatgcgtgccttgctctttatt

SEQ ID NO: 2339 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgctgattggatgacgagctgtgtraccagtcacactgggactacattat

SEQ ID NO: 2340 - DNA, 50 bp, Artificial Sequence
  synthetic Elaeis guineensis (oil palm) single nucleotide polymorphism (SNP) in genomic region adjacent to shatterproof1 (SHELL) shell thickness gene
tattctctttctttgttgttttgtmacatgtcttggtatgactagttcca

SEQ ID NO: 2341 - DNA, 50 bp, Artificial Sequence
  synthetic Elaeis guineensis (oil palm) single nucleotide polymorphism (SNP) in genomic region adjacent to shatterproof1 (SHELL) shell thickness gene
atgttccaaccttttcccttgtatwctatgatattagcctcatttagctg

SEQ ID NO: 2342 - DNA, 50 bp, Artificial Sequence
  synthetic Elaeis guineensis (oil palm) single nucleotide polymorphism (SNP) in genomic region adjacent to shatterproof1 (SHELL) shell thickness gene
gctttaattgaatcatcattcttcyctgctcttcaggtatttaagtgaaa

SEQ ID NO: 2343 - DNA, 50 bp, Artificial Sequence
  synthetic Elaeis guineensis (oil palm) single nucleotide polymorphism (SNP) in genomic region adjacent to shatterproof1 (SHELL) shell thickness gene
catcagctataaaggacactggggscctgagcaagcatttaactgtataa

SEQ ID NO: 2344 - DNA, 50 bp, Artificial Sequence
  synthetic Elaeis guineensis (oil palm) single nucleotide polymorphism (SNP) in genomic region adjacent to shatterproof1 (SHELL) shell thickness gene
agcaagcatttaactgtataacaarttttcttctttattttgtagatcaa

SEQ ID NO: 2345 - DNA, 50 bp, Artificial Sequence
  synthetic Elaeis guineensis (oil palm) single nucleotide polymorphism (SNP) in genomic region adjacent to shatterproof1 (SHELL) shell thickness gene
cacaggcaatcttcaaagtcttccrgacatgtttactccttcaaattatg

SEQ ID NO: 2346 - DNA, 50 bp, Artificial Sequence
  synthetic Elaeis guineensis (oil palm) single nucleotide polymorphism (SNP) in genomic region adjacent to shatterproof1 (SHELL) shell thickness gene
acaactagtgaaggcgaaatattayctcttcaaggtttaaattcttgtca

SEQ ID NO: 2347 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgggaagaaggaacatgctttatakaatgcacagaaaggtcaaatttata

SEQ ID NO: 2348 - DNA, 50 bp, Artificial Sequence
  synthetic Elaeis guineensis (oil palm) single nucleotide polymorphism (SNP) in genomic region adjacent to shatterproof1 (SHELL) shell thickness gene
taacgtgatactaccacaagatatrtgcgttgatgtgccacatcccttat

SEQ ID NO: 2349 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctcgactaggtaagcactatgccakgacaaatggtcagcagtactctgtg

SEQ ID NO: 2350 - DNA, 50 bp, Artificial Sequence
  synthetic Elaeis guineensis (oil palm) single nucleotide polymorphism (SNP) in genomic region adjacent to shatterproof1 (SHELL) shell thickness gene
tagggaatgagatctatagtaaatmaataattttctctacatgttcatct

SEQ ID NO: 2351 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatccactctccatctatcaacctycttgattttcttgtagacgactact

SEQ ID NO: 2352 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcttgtagacgactacttaaatttytcactttaccattttgagtatgttc

SEQ ID NO: 2353 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaacctgaatatgaacagggggagrcaggaaggatgtcagcaagtgatcc

SEQ ID NO: 2354 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccaaagacataaaaaataaggtttrtcttctatgtagcatcccaattttt

SEQ ID NO: 2355 - DNA, 50 bp, Artificial Sequence
  synthetic Elaeis guineensis (oil palm) single nucleotide polymorphism (SNP) in genomic region adjacent to shatterproof1 (SHELL) shell thickness gene
atatttctttatgtgtgttatgttycaatgtttattaaaaattaaggtgt

SEQ ID NO: 2356 - DNA, 50 bp, Artificial Sequence
  synthetic Elaeis guineensis (oil palm) single nucleotide polymorphism (SNP) in genomic region adjacent to shatterproof1 (SHELL) shell thickness gene
gttttacttcccattggttccaagwctaggatcaatatctttttctttac

SEQ ID NO: 2357 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcagagtaggatactgtttagcgtwtggagaatcctttatactggatgtt

SEQ ID NO: 2358 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcaggttgattttttccaatgtatmatttttttttttgcaaggctatgat

SEQ ID NO: 2359 - DNA, 50 bp, Artificial Sequence
  synthetic Elaeis guineensis (oil palm) single nucleotide polymorphism (SNP) in genomic region adjacent to shatterproof1 (SHELL) shell thickness gene
gctcatgagtttctctaaaatactytagtcaatggcggatgttcagtttt

SEQ ID NO: 2360 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttattttataatgtgttaaaataraatttggctgtttatagagttctga

SEQ ID NO: 2361 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgtttatagagttctgaggtcctcrctcctttttttcttgaaacacatat

SEQ ID NO: 2362 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttatagagttctgaggtcctcactyctttttttcttgaaacacatatctt

SEQ ID NO: 2363 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctcctctgtcgacgtaataatgtrttcattttaaactcttcttttgttt

SEQ ID NO: 2364 - DNA, 50 bp, Artificial Sequence
  synthetic Elaeis guineensis (oil palm) single nucleotide polymorphism (SNP) in genomic region adjacent to shatterproof1 (SHELL) shell thickness gene
cttttgtttgtgttcttcacaaccyattcaacaatttcttctttaccatt

SEQ ID NO: 2365 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaataatctttctccccactccccsttcccaactgatcaattatgaccta

SEQ ID NO: 2366 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccagaaggatgttggtattgacaakaaattaacaaaatgccatgtttgca

SEQ ID NO: 2367 - DNA, 50 bp, Artificial Sequence
  synthetic Elaeis guineensis (oil palm) single nucleotide polymorphism (SNP) in genomic region adjacent to shatterproof1 (SHELL) shell thickness gene
tccattcaatatcaaaaaaataaayatataaaagatagaaatataattta

SEQ ID NO: 2368 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaatcttgattctttcatcagcttycatgcaacaccatggtaaccctgag

SEQ ID NO: 2369 - DNA, 50 bp, Artificial Sequence
  synthetic Elaeis guineensis (oil palm) single nucleotide polymorphism (SNP) in genomic region adjacent to shatterproof1 (SHELL) shell thickness gene
aacaccatggtaaccctgagaatcygaaagcaatccagtttttggatgag

SEQ ID NO: 2370 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgggtctggttgtgtccaggtcaayctttgtgaaagctgaactagcccag

SEQ ID NO: 2371 - DNA, 50 bp, Artificial Sequence
  synthetic Elaeis guineensis (oil palm) single nucleotide polymorphism (SNP) in genomic region adjacent to shatterproof1 (SHELL) shell thickness gene
atactttttctttgtaggtgaatasatatgctttttctggtggccaagat

SEQ ID NO: 2372 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaatatatggcatgagagataattktagtagttcattttactatattgat

SEQ ID NO: 2373 - DNA, 50 bp, Artificial Sequence
  synthetic Elaeis guineensis (oil palm) single nucleotide polymorphism (SNP) in genomic region adjacent to shatterproof1 (SHELL) shell thickness gene
gttaacttcctccactgtgggtaasttatacatgaataacctacttgtct

SEQ ID NO: 2374 - DNA, 50 bp, Artificial Sequence
  synthetic Elaeis guineensis (oil palm) single nucleotide polymorphism (SNP) in genomic region adjacent to shatterproof1 (SHELL) shell thickness gene
acaggtttatatattttagtttatrtttattcataagaaaaaaatgaaaa

SEQ ID NO: 2375 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttatatttattcataagaaaaaaaygaaaaacattcatgagaaccaattt

SEQ ID NO: 2376 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatctcttccttcttgccccagtgyaggtactttgttggcacctcccatt

SEQ ID NO: 2377 - DNA, 50 bp, Artificial Sequence
  synthetic Elaeis guineensis (oil palm) single nucleotide polymorphism (SNP) in genomic region adjacent to shatterproof1 (SHELL) shell thickness gene
atctcttccttcttgccccagtgcrggtactttgttggcacctcccattc

SEQ ID NO: 2378 - DNA, 50 bp, Artificial Sequence
  synthetic Elaeis guineensis (oil palm) single nucleotide polymorphism (SNP) in genomic region adjacent to shatterproof1 (SHELL) shell thickness gene
atgagattcatgactaacaattctwgatttttttttcccagatggtggat

SEQ ID NO: 2379 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggattaaaatgatcaaacagcagastttttctgctttactgattatcact

SEQ ID NO: 2380 - DNA, 50 bp, Artificial Sequence
  synthetic Elaeis guineensis (oil palm) single nucleotide polymorphism (SNP) in genomic region adjacent to shatterproof1 (SHELL) shell thickness gene
cgattgacactcaaaatactttttkgtgttacacaagtattcctgttctc

SEQ ID NO: 2381 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttcatgtaacagtgcttcatagcakgactgatgggattgtgaatggctgt

SEQ ID NO: 2382 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatataatttgaagatatctgttcsctgtacctgtttggtaactggtcgc

SEQ ID NO: 2383 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatctgttcgctgtacctgtttggwaactggtcgctgggtgtaagtgaat

SEQ ID NO: 2384 - DNA, 50 bp, Artificial Sequence
  synthetic Elaeis guineensis (oil palm) single nucleotide polymorphism (SNP) in genomic region adjacent to shatterproof1 (SHELL) shell thickness gene
gttgcagttttccacacgcattctmagccattttcttacagggtatcagt

SEQ ID NO: 2385 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctgtgggcttttcaccagctctamttggttgccttgaggaaaaattgga

SEQ ID NO: 2386 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaattggatcattctttatacaakgaccggtaaagaaaaataaaaattt

SEQ ID NO: 2387 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgtaatgagaccaagaaccatgtawggaatttaatttttgctagcaaata

SEQ ID NO: 2388 - DNA, 50 bp, Artificial Sequence
  synthetic Elaeis guineensis (oil palm) single nucleotide polymorphism (SNP) in genomic region adjacent to shatterproof1 (SHELL) shell thickness gene
accaagaaccatgtatggaatttartttttgctagcaaatattaaaaaat

SEQ ID NO: 2389 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcctctttttctctctccatttttytcttttcagttttcgtagttaggtt

SEQ ID NO: 2390 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttttctctctccatttttctctttycagttttcgtagttaggtttctcat

SEQ ID NO: 2391 - DNA, 50 bp, Artificial Sequence
  synthetic Elaeis guineensis (oil palm) single nucleotide polymorphism (SNP) in genomic region adjacent to shatterproof1 (SHELL) shell thickness gene
cagggtttttgttaccaaaaggatstatcaccacaaaaggtgcatcttgt

SEQ ID NO: 2392 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttaacgtatcattatatgattgttwatggaaaaaatgtgagcagttttct

SEQ ID NO: 2393 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcttgtttgtatatgtgaggcaatyttagaaataattataagttgcacct

SEQ ID NO: 2394 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgattgttgaaaattaaaaatattwtaagaaatatagcataatacatggg

SEQ ID NO: 2395 - DNA, 50 bp, Artificial Sequence
  synthetic Elaeis guineensis (oil palm) single nucleotide polymorphism (SNP) in genomic region adjacent to shatterproof1 (SHELL) shell thickness gene
taatacatgggtattggaatttgayctctccaacattaatttaaagtttc

SEQ ID NO: 2396 - DNA, 50 bp, Artificial Sequence
  synthetic Elaeis guineensis (oil palm) single nucleotide polymorphism (SNP) in genomic region adjacent to shatterproof1 (SHELL) shell thickness gene
atcaagaaaggttctgagtggctgkgccagtcacccaatggcatactatg

SEQ ID NO: 2397 - DNA, 50 bp, Artificial Sequence
  synthetic Elaeis guineensis (oil palm) single nucleotide polymorphism (SNP) in genomic region adjacent to shatterproof1 (SHELL) shell thickness gene
gagatgttcttttagttaataaaartaaaaaaatggagttaaatggcatt

SEQ ID NO: 2398 - DNA, 50 bp, Artificial Sequence
  synthetic Elaeis guineensis (oil palm) single nucleotide polymorphism (SNP) in genomic region adjacent to shatterproof1 (SHELL) shell thickness gene
aataaaaaaatggagttaaatggcrttgcaccagcccattccttgtgcca

SEQ ID NO: 2399 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccagtattggactagcatgatgagycaagctatattattggcacttatct

SEQ ID NO: 2400 - DNA, 50 bp, Artificial Sequence
  synthetic Elaeis guineensis (oil palm) single nucleotide polymorphism (SNP) in genomic region adjacent to shatterproof1 (SHELL) shell thickness gene
atgagtcaagctatattattggcayttatcttgagcaaaagtatcatcgg

SEQ ID NO: 2401 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcggcacttgaaaccatgattctgrgcatgttagatttttttattctttt

SEQ ID NO: 2402 - DNA, 50 bp, Artificial Sequence
  synthetic Elaeis guineensis (oil palm) single nucleotide polymorphism (SNP) in genomic region adjacent to shatterproof1 (SHELL) shell thickness gene
gctctttgtaaaactgcttgatgawtttctgttgtacgatatatcacaaa

SEQ ID NO: 2403 - DNA, 50 bp, Artificial Sequence
  synthetic Elaeis guineensis (oil palm) single nucleotide polymorphism (SNP) in genomic region adjacent to shatterproof1 (SHELL) shell thickness gene
actgcttgatgattttctgttgtaygatatatcacaaaggtagccacaca

SEQ ID NO: 2404 - DNA, 50 bp, Artificial Sequence
  synthetic Elaeis guineensis (oil palm) single nucleotide polymorphism (SNP) in genomic region adjacent to shatterproof1 (SHELL) shell thickness gene
tagagtatattggctttgtgtttgragtgttgctcaaaattgcgaccaaa

SEQ ID NO: 2405 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttcaaaataagtcctgcagtgctamatattaaattcgtaaaatcattggc

SEQ ID NO: 2406 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatagatttattttatttttcgtcrctttttctcttaatttcttttttta

SEQ ID NO: 2407 - DNA, 50 bp, Artificial Sequence
  synthetic Elaeis guineensis (oil palm) single nucleotide polymorphism (SNP) in genomic region adjacent to shatterproof1 (SHELL) shell thickness gene
tagatttattttatttttcgtcgcyttttctcttaatttctttttttaca

SEQ ID NO: 2408 - DNA, 50 bp, Artificial Sequence
  synthetic Elaeis guineensis (oil palm) single nucleotide polymorphism (SNP) in genomic region adjacent to shatterproof1 (SHELL) shell thickness gene
actaaagctaatgtactgaggataygtggtgcttttttgtttgatgatta

SEQ ID NO: 2409 - DNA, 50 bp, Artificial Sequence
  synthetic Elaeis guineensis (oil palm) single nucleotide polymorphism (SNP) in genomic region adjacent to shatterproof1 (SHELL) shell thickness gene
aataaagagccagcattactatttygagaaacatttggttgatggtttac

SEQ ID NO: 2410 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttactatttcgagaaacatttggtwgatggtttactatgttttgttcatg

SEQ ID NO: 2411 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggaaatctttcttaaacagacagcmggatcatactcctttgattgtatct

SEQ ID NO: 2412 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtttttgtctagacagggaatcttycatattctaaatatggacctattcc

SEQ ID NO: 2413 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagatatgtggttcattcttgaatwaactgagcacttgcagctgttatgt

SEQ ID NO: 2414 - DNA, 50 bp, Artificial Sequence
  synthetic Elaeis guineensis (oil palm) single nucleotide polymorphism (SNP) in genomic region adjacent to shatterproof1 (SHELL) shell thickness gene
agcttcagcaagaaggttgtttgtyctccgggttctacttctgagtcaac

SEQ ID NO: 2415 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttattatttgcttcaggtgatgcrctgcacaccagtcctgatggttggc

SEQ ID NO: 2416 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaagaagattttgcaaaggcaagtstgggtttagaactagatgcaggtat

SEQ ID NO: 2417 - DNA, 50 bp, Artificial Sequence
  synthetic Elaeis guineensis (oil palm) single nucleotide polymorphism (SNP) in genomic region adjacent to shatterproof1 (SHELL) shell thickness gene
atgtgaggatctgatattatgatarttaatgaacgagaagcagttctgtt

SEQ ID NO: 2418 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttttgctttcacatctgaacatgamaaagaggtcaacatagtttattttg

SEQ ID NO: 2419 - DNA, 50 bp, Artificial Sequence
  synthetic Elaeis guineensis (oil palm) single nucleotide polymorphism (SNP) in genomic region adjacent to shatterproof1 (SHELL) shell thickness gene
gttttgttatccaagcctctagaayagattttagctgattcaatctgaac

SEQ ID NO: 2420 - DNA, 50 bp, Artificial Sequence
  synthetic Elaeis guineensis (oil palm) single nucleotide polymorphism (SNP) in genomic region adjacent to shatterproof1 (SHELL) shell thickness gene
aggagaagagtagggtaatgagccrtgaacaatagtgcacaagtgagcaa

SEQ ID NO: 2421 - DNA, 50 bp, Artificial Sequence
  synthetic Elaeis guineensis (oil palm) single nucleotide polymorphism (SNP) in genomic region adjacent to shatterproof1 (SHELL) shell thickness gene
agcaacaagggattactctatgttkaaataatcaattttgaattggatct

SEQ ID NO: 2422 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaccctctaaaaagggcaaccattrttaaataatcatttcaagagtattc

SEQ ID NO: 2423 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcatcagtatgccctgtatcctgckacaacttaagtgcccatgctgttaa

SEQ ID NO: 2424 - DNA, 50 bp, Artificial Sequence
  synthetic Elaeis guineensis (oil palm) single nucleotide polymorphism (SNP) in genomic region adjacent to shatterproof1 (SHELL) shell thickness gene
accttatcaaactggtatctcagcrtttgtgtcactgtttcacccaatta

SEQ ID NO: 2425 - DNA, 50 bp, Artificial Sequence
  synthetic Elaeis guineensis (oil palm) single nucleotide polymorphism (SNP) in genomic region adjacent to shatterproof1 (SHELL) shell thickness gene
atctgaaaatctagcacctgtgacmgcacacattttctgtcagattaagt

SEQ ID NO: 2426 - DNA, 50 bp, Artificial Sequence
  synthetic Elaeis guineensis (oil palm) single nucleotide polymorphism (SNP) in genomic region adjacent to shatterproof1 (SHELL) shell thickness gene
cttaagacttcatgcttcaacgatyctcaacatggctaaataaacaatag

SEQ ID NO: 2427 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatgcagtgcattcattttgttgcwgctcccctgcaaaattgggattatt

SEQ ID NO: 2428 - DNA, 50 bp, Artificial Sequence
  synthetic Elaeis guineensis (oil palm) single nucleotide polymorphism (SNP) in genomic region adjacent to shatterproof1 (SHELL) shell thickness gene
tccttatgaatagcataaaactctyatgccacatcggatgggttattgag

SEQ ID NO: 2429 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggcctaagtggttgctcaaggcacraaacctgcattccaggtcacgtttg

SEQ ID NO: 2430 - DNA, 50 bp, Artificial Sequence
  synthetic Elaeis guineensis (oil palm) single nucleotide polymorphism (SNP) in genomic region adjacent to shatterproof1 (SHELL) shell thickness gene
caaaacctgcattccaggtcacgtytgaatatttttggaatgaatcatac

SEQ ID NO: 2431 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatcatactaatgaatgctttcttkgatggaatttgtagcaataaacatc

SEQ ID NO: 2432 - DNA, 50 bp, Artificial Sequence
  synthetic Elaeis guineensis (oil palm) single nucleotide polymorphism (SNP) in genomic region adjacent to shatterproof1 (SHELL) shell thickness gene
atcgggtccatactggtcttgagckggaacagtatggtactggtacagtt

SEQ ID NO: 2433 - DNA, 50 bp, Artificial Sequence
  synthetic Elaeis guineensis (oil palm) single nucleotide polymorphism (SNP) in genomic region adjacent to shatterproof1 (SHELL) shell thickness gene
atcctttccaatcattgtcaaaccrcaaatcgcatgcggggttgcggatg

SEQ ID NO: 2434 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatctttttatcttccagttggctygactgacaactgacaaagtgcaact

SEQ ID NO: 2435 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgacaactgacaaagtgcaacttcrgctataaaagctatttagttgattt

SEQ ID NO: 2436 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaaaaaatttatctccacctttcmgcttttgagaaatggatatactcaa

SEQ ID NO: 2437 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttgctgttattatctttaaatcatyattgttattatatctttatcattct

SEQ ID NO: 2438 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttagttaagttggcttcttgctcmaatcattttttgttttcttatcctt

SEQ ID NO: 2439 - DNA, 50 bp, Artificial Sequence
  synthetic Elaeis guineensis (oil palm) single nucleotide polymorphism (SNP) in genomic region adjacent to shatterproof1 (SHELL) shell thickness gene
agctattcttcaggtaaacaagaakcacctgcagatgatgcatcataagt

SEQ ID NO: 2440 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgaatatcaagagaaattgcgcttygtacattgtgattcagttttttaca

SEQ ID NO: 2441 - DNA, 50 bp, Artificial Sequence
  synthetic Elaeis guineensis (oil palm) single nucleotide polymorphism (SNP) in genomic region adjacent to shatterproof1 (SHELL) shell thickness gene
atgctttaggtgttcagatgattayactgtcctaaaacaaaaatcttaaa

SEQ ID NO: 2442 - DNA, 50 bp, Artificial Sequence
  synthetic Elaeis guineensis (oil palm) single nucleotide polymorphism (SNP) in genomic region adjacent to shatterproof1 (SHELL) shell thickness gene
gagaagtatataaaatgtaaatcakgctacaaactagaactaattttgct

SEQ ID NO: 2443 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttcatggttcttttaaagaacttkagaataaattagatttgtaatcatg

SEQ ID NO: 2444 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatgtttacgtttgttacagtatcratcgctctccaaccactccacatgc

SEQ ID NO: 2445 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcgatcgctctccaaccactccacrtgcttttgtgggatcaggtgttgag

SEQ ID NO: 2446 - DNA, 50 bp, Artificial Sequence
  synthetic Elaeis guineensis (oil palm) single nucleotide polymorphism (SNP) in genomic region adjacent to shatterproof1 (SHELL) shell thickness gene
agatccaacaattgcgagcacaagycttggccaaaaacagtgactttacc

SEQ ID NO: 2447 - DNA, 50 bp, Artificial Sequence
  synthetic Elaeis guineensis (oil palm) single nucleotide polymorphism (SNP) in genomic region adjacent to shatterproof1 (SHELL) shell thickness gene
tggttgctcaagtcaaaatcagacrtcatgcatcaatacatagtttaggt

SEQ ID NO: 2448 - DNA, 50 bp, Artificial Sequence
  synthetic Elaeis guineensis (oil palm) single nucleotide polymorphism (SNP) in genomic region adjacent to shatterproof1 (SHELL) shell thickness gene
agcagtcactgcagtgccctcaatrtgagaagatccagtagttggagtgt

SEQ ID NO: 2449 - DNA, 50 bp, Artificial Sequence
  synthetic Elaeis guineensis (oil palm) single nucleotide polymorphism (SNP) in genomic region adjacent to shatterproof1 (SHELL) shell thickness gene
gttgctgcctctggacttaaacccrtgccattgcacttgtcagtgcaagc

SEQ ID NO: 2450 - DNA, 50 bp, Artificial Sequence
  synthetic Elaeis guineensis (oil palm) single nucleotide polymorphism (SNP) in genomic region adjacent to shatterproof1 (SHELL) shell thickness gene
taggaattgaacctacgccatcatrcttgtcagcccaagtcttttaccat

SEQ ID NO: 2451 - DNA, 50 bp, Artificial Sequence
  synthetic Elaeis guineensis (oil palm) single nucleotide polymorphism (SNP) in genomic region adjacent to shatterproof1 (SHELL) shell thickness gene
cagcaatagcctctttgcaaggtgrcaattggaaaccttaccatcaacca

SEQ ID NO: 2452 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaatgggtcatgtaggccattaagycacaatggatcagtcctacttcaat

SEQ ID NO: 2453 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttgagttgtgttatgggttaggcytgaaagattttggactggtttggag

SEQ ID NO: 2454 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggcctgaaagattttggactggttyggagttaaatacagagcccatatgt

SEQ ID NO: 2455 - DNA, 50 bp, Artificial Sequence
  synthetic Elaeis guineensis (oil palm) single nucleotide polymorphism (SNP) in genomic region adjacent to shatterproof1 (SHELL) shell thickness gene
agttaaatacagagcccatatgttytttgggttgggctcaggtatatcat

SEQ ID NO: 2456 - DNA, 50 bp, Artificial Sequence
  synthetic Elaeis guineensis (oil palm) single nucleotide polymorphism (SNP) in genomic region adjacent to shatterproof1 (SHELL) shell thickness gene
aggcccaaaatggagcttgaactcmagcatgaaatggagtccaaacttag

SEQ ID NO: 2457 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctggtaaatatgttctgatcatcrgatggttgctaacatgaagctacag

SEQ ID NO: 2458 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggatggttgctaacatgaagctacrgtattttatcagaaaaaatgtgaag

SEQ ID NO: 2459 - DNA, 50 bp, Artificial Sequence
  synthetic Elaeis guineensis (oil palm) single nucleotide polymorphism (SNP) in genomic region adjacent to shatterproof1 (SHELL) shell thickness gene
cttcaatcgggtttgggccagcccwatttttatcccaaatggataacttg

SEQ ID NO: 2460 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcagttgtgatatcttaatgcatcrttggcatcaataggttatccagatt

SEQ ID NO: 2461 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgcatcgttggcatcaataggttawccagattgggctacatcatgcaagt

SEQ ID NO: 2462 - DNA, 50 bp, Artificial Sequence
  synthetic Elaeis guineensis (oil palm) single nucleotide polymorphism (SNP) in genomic region adjacent to shatterproof1 (SHELL) shell thickness gene
tacatcatgcaagtttgattaaccwataaattagttctttgtgcttctaa

SEQ ID NO: 2463 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttagttctttgtgcttctaaatggygagagcaacttttctggacagagaa

SEQ ID NO: 2464 - DNA, 50 bp, Artificial Sequence
  synthetic Elaeis guineensis (oil palm) single nucleotide polymorphism (SNP) in genomic region adjacent to shatterproof1 (SHELL) shell thickness gene
tccaagaagacctttgttgatggaygagcagaatacatgagaggtacaaa

SEQ ID NO: 2465 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaatctgttgtggaaaaacagcccrgtcacaaaacctgaaaaatgcttta

SEQ ID NO: 2466 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttttcctgatttttccatcaaatayattttgcccaaaatcaagttacaaa

SEQ ID NO: 2467 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagaagataaaagatccggaaatcyttgttgctctgcagcagttagtaga

SEQ ID NO: 2468 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaagcaatatttcggaagatggctycttggctccctgagttgtcagacat

SEQ ID NO: 2469 - DNA, 50 bp, Artificial Sequence
  synthetic Elaeis guineensis (oil palm) single nucleotide polymorphism (SNP) in genomic region adjacent to shatterproof1 (SHELL) shell thickness gene
atttatgttcaattttttgtattayaaatatttttcttggcatctccttg

SEQ ID NO: 2470 - DNA, 50 bp, Artificial Sequence
  synthetic Elaeis guineensis (oil palm) single nucleotide polymorphism (SNP) in genomic region adjacent to shatterproof1 (SHELL) shell thickness gene
attttttgtattataaatatttttyttggcatctccttgttcttacaatt

SEQ ID NO: 2471 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctttgcatgcccatccactacctrccatcttctaaaacatcggtataaa

SEQ ID NO: 2472 - DNA, 50 bp, Artificial Sequence
  synthetic Elaeis guineensis (oil palm) single nucleotide polymorphism (SNP) in genomic region adjacent to shatterproof1 (SHELL) shell thickness gene
ataaagccatatgtttctaaatgcmcaatgaaagaagctaaacagagatt

SEQ ID NO: 2473 - DNA, 50 bp, Artificial Sequence
  synthetic Elaeis guineensis (oil palm) single nucleotide polymorphism (SNP) in genomic region adjacent to shatterproof1 (SHELL) shell thickness gene
atttgggcatcatgggttcaaacaygaaaacagcctttcagcatacgggg

SEQ ID NO: 2474 - DNA, 50 bp, Artificial Sequence
  synthetic Elaeis guineensis (oil palm) single nucleotide polymorphism (SNP) in genomic region adjacent to shatterproof1 (SHELL) shell thickness gene
gggcaagactgcttacatttaaccytctccaaaccctgcagtagtgggag

SEQ ID NO: 2475 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggccaatttgaagtttgaaacctgmgtggattattctagatatgcatgtt

SEQ ID NO: 2476 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctggaggcacttgacaagattattsgagatgaaagttataattttgataa

SEQ ID NO: 2477 - DNA, 50 bp, Artificial Sequence
  synthetic Elaeis guineensis (oil palm) single nucleotide polymorphism (SNP) in genomic region adjacent to shatterproof1 (SHELL) shell thickness gene
agtagaattacttttattaattcgyagttattaatagagatcctaaatgc

SEQ ID NO: 2478 - DNA, 50 bp, Artificial Sequence
  synthetic Elaeis guineensis (oil palm) single nucleotide polymorphism (SNP) in genomic region adjacent to shatterproof1 (SHELL) shell thickness gene
cctgcaactatcatgcatcctaatygctattcacagttgctgtgtagaac

SEQ ID NO: 2479 - DNA, 50 bp, Artificial Sequence
  synthetic Elaeis guineensis (oil palm) single nucleotide polymorphism (SNP) in genomic region adjacent to shatterproof1 (SHELL) shell thickness gene
tattcacagttgctgtgtagaacakgcaaaaaactgaaacctatataata

SEQ ID NO: 2480 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaaaagaaaagatgagaaaccaacyatccctccataattggtttctggtt

SEQ ID NO: 2481 - DNA, 50 bp, Artificial Sequence
  synthetic Elaeis guineensis (oil palm) single nucleotide polymorphism (SNP) in genomic region adjacent to shatterproof1 (SHELL) shell thickness gene
caccttcacaccttgtctgccccawggctaggcgacttcacttgggcatt

SEQ ID NO: 2482 - DNA, 50 bp, Artificial Sequence
  synthetic Elaeis guineensis (oil palm) single nucleotide polymorphism (SNP) in genomic region adjacent to shatterproof1 (SHELL) shell thickness gene
taggcgacttcacttgggcattcaraaagcatgccttttatatgccttgc

SEQ ID NO: 2483 - DNA, 50 bp, Artificial Sequence
  synthetic Elaeis guineensis (oil palm) single nucleotide polymorphism (SNP) in genomic region adjacent to shatterproof1 (SHELL) shell thickness gene
agaaaagtacattgtactgtttttkattaggaatttggtgattaaccaga

SEQ ID NO: 2484 - DNA, 50 bp, Artificial Sequence
  synthetic Elaeis guineensis (oil palm) single nucleotide polymorphism (SNP) in genomic region adjacent to shatterproof1 (SHELL) shell thickness gene
tggtgattaaccagaagagagaagrgggaaagatattgtagaaaaaagga

SEQ ID NO: 2485 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttctttttcttccatttgataaatyccttattcttcctgttcttcttctc

SEQ ID NO: 2486 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttttcttccatttgataaattcctwattcttcctgttcttcttctctttt

SEQ ID NO: 2487 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggccctcctctgctgctgcaactaytgactgatgcttctgtgctcatatg

SEQ ID NO: 2488 - DNA, 50 bp, Artificial Sequence
  synthetic Elaeis guineensis (oil palm) single nucleotide polymorphism (SNP) in genomic region adjacent to shatterproof1 (SHELL) shell thickness gene
caactattgactgatgcttctgtgytcatatgtatgtgcgtatgcatgtg

SEQ ID NO: 2489 - DNA, 50 bp, Artificial Sequence
  synthetic Elaeis guineensis (oil palm) single nucleotide polymorphism (SNP) in genomic region adjacent to shatterproof1 (SHELL) shell thickness gene
gctcatatgtatgtgcgtatgcatrtgtacatatatgtatatgtacatat

SEQ ID NO: 2490 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttccacagcagctcagaagttcagyaatgatttagcatcaaaaactctgc

SEQ ID NO: 2491 - DNA, 50 bp, Artificial Sequence
  synthetic Elaeis guineensis (oil palm) single nucleotide polymorphism (SNP) in genomic region adjacent to shatterproof1 (SHELL) shell thickness gene
acatttcagaaacaagatatagagygacatggtttaactgtttgctattg

SEQ ID NO: 2492 - DNA, 50 bp, Artificial Sequence
  synthetic Elaeis guineensis (oil palm) single nucleotide polymorphism (SNP) in genomic region adjacent to shatterproof1 (SHELL) shell thickness gene
taactgtttgctattgatttttaawgaaaatatatatgagaagtttttct

SEQ ID NO: 2493 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaataacagaaaatttcaattaaraatataagatgtaattttaaaattg

SEQ ID NO: 2494 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggtgtttcttcacgttttcactcarggggccaaagaaagcatagacttct

SEQ ID NO: 2495 - DNA, 50 bp, Artificial Sequence
  synthetic Elaeis guineensis (oil palm) single nucleotide polymorphism (SNP) in genomic region adjacent to shatterproof1 (SHELL) shell thickness gene
atcctggctctacccttgcaatgcrtaccaagtccagcactccagtttgg

SEQ ID NO: 2496 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaacttaaattgcaactagccaacyatactcatggcagcttgatgaatac

SEQ ID NO: 2497 - DNA, 50 bp, Artificial Sequence
  synthetic Elaeis guineensis (oil palm) single nucleotide polymorphism (SNP) in genomic region adjacent to shatterproof1 (SHELL) shell thickness gene
tggcttggccatgcacatcagaagycttgtacgagtgcctgctgatctcc

SEQ ID NO: 2498 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgcacatcagaagtcttgtacgagygcctgctgatctcccatacaaaatt

SEQ ID NO: 2499 - DNA, 50 bp, Artificial Sequence
  synthetic Elaeis guineensis (oil palm) single nucleotide polymorphism (SNP) in genomic region adjacent to shatterproof1 (SHELL) shell thickness gene
attgctttggtatttggactcgacrttccaacttatagttggctctactt

SEQ ID NO: 2500 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgaagtctcttccagttgctactgrggaccagttctcagcaggtgggcca

SEQ ID NO: 2501 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccatgcctttctctactgaaatgtktaagctgtaatactgctgctgctag

SEQ ID NO: 2502 - DNA, 50 bp, Artificial Sequence
  synthetic Elaeis guineensis (oil palm) single nucleotide polymorphism (SNP) in genomic region adjacent to shatterproof1 (SHELL) shell thickness gene
taacccattcaaatttatcgcgggycatgagataaactgcatttcctaga

SEQ ID NO: 2503 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccacaaaattcaccatgggctgttwtatcatcatggtagcagatatttga

SEQ ID NO: 2504 - DNA, 50 bp, Artificial Sequence
  synthetic Elaeis guineensis (oil palm) single nucleotide polymorphism (SNP) in genomic region adjacent to shatterproof1 (SHELL) shell thickness gene
actattctcatcacttttcacgttsagcctgcaccaaagaataaaccttt

SEQ ID NO: 2505 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctgtaggcataatagcttctttctyatctggtacacaaactatttagctg

SEQ ID NO: 2506 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcatgattctcagattcccatattycaagaaaaaccaaagccaaaacaaa

SEQ ID NO: 2507 - DNA, 50 bp, Artificial Sequence
  synthetic Elaeis guineensis (oil palm) single nucleotide polymorphism (SNP) in genomic region adjacent to shatterproof1 (SHELL) shell thickness gene
gatcgcaggcccactggaaaatggwgctcagaaaggtgtgtctcagtttc

SEQ ID NO: 2508 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctcagtttctttatcagatccacwagcggatctgctgcaattcatgctg

SEQ ID NO: 2509 - DNA, 50 bp, Artificial Sequence
  synthetic Elaeis guineensis (oil palm) single nucleotide polymorphism (SNP) in genomic region adjacent to shatterproof1 (SHELL) shell thickness gene
caagcggatctgctgcaattcatgytgcattggatcctctccatgccagg

SEQ ID NO: 2510 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccattggttttggtttgttgggggraacgccttatggcatgttacagtag

SEQ ID NO: 2511 - DNA, 50 bp, Artificial Sequence
  synthetic Elaeis guineensis (oil palm) single nucleotide polymorphism (SNP) in genomic region adjacent to shatterproof1 (SHELL) shell thickness gene
taacttcagatgatctggccgataragcaccttcgttgtggttcttaatc

SEQ ID NO: 2512 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgtcaaatgaccggaaacttcatcygtagtgcatcaagaaatgtatccca

SEQ ID NO: 2513 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtccaggaagttgaaggtttttcayaaagaaagccgccagtctgcttact

SEQ ID NO: 2514 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcacttcctccaggattatacatcwaaacttttattctgtttttacagaa

SEQ ID NO: 2515 - DNA, 50 bp, Artificial Sequence
  synthetic Elaeis guineensis (oil palm) single nucleotide polymorphism (SNP) in genomic region adjacent to shatterproof1 (SHELL) shell thickness gene
caaagatcgccacttaaattaaccrgcagttttacctttcaagcttctgg

SEQ ID NO: 2516 - DNA, 50 bp, Artificial Sequence
  synthetic Elaeis guineensis (oil palm) single nucleotide polymorphism (SNP) in genomic region adjacent to shatterproof1 (SHELL) shell thickness gene
acatttgcaatttttcttgcctgtytgagaggttgaagttgaaaaagaaa

SEQ ID NO: 2517 - DNA, 50 bp, Artificial Sequence
  synthetic Elaeis guineensis (oil palm) single nucleotide polymorphism (SNP) in genomic region adjacent to shatterproof1 (SHELL) shell thickness gene
aggttgaagttgaaaaagaaatcaycagcattagccagaaccagtcatac

SEQ ID NO: 2518 - DNA, 50 bp, Artificial Sequence
  synthetic Elaeis guineensis (oil palm) single nucleotide polymorphism (SNP) in genomic region adjacent to shatterproof1 (SHELL) shell thickness gene
gttgggtaaatttgatttctgcacmtggagaaacctgcaaagcaaataat

SEQ ID NO: 2519 - DNA, 50 bp, Artificial Sequence
  synthetic Elaeis guineensis (oil palm) single nucleotide polymorphism (SNP) in genomic region adjacent to shatterproof1 (SHELL) shell thickness gene
taaatcttaacaaaatttcctgtcmaatcacaaacatcacctatgcagcg

SEQ ID NO: 2520 - DNA, 50 bp, Artificial Sequence
  synthetic Elaeis guineensis (oil palm) single nucleotide polymorphism (SNP) in genomic region adjacent to shatterproof1 (SHELL) shell thickness gene
taaagatatgaattcctactttacratgccactcttatgcaccagcatcg

SEQ ID NO: 2521 - DNA, 50 bp, Artificial Sequence
  synthetic Elaeis guineensis (oil palm) single nucleotide polymorphism (SNP) in genomic region adjacent to shatterproof1 (SHELL) shell thickness gene
atgccactcttatgcaccagcatcktcctgaatgttcccatcagacttct

SEQ ID NO: 2522 - DNA, 50 bp, Artificial Sequence
  synthetic Elaeis guineensis (oil palm) single nucleotide polymorphism (SNP) in genomic region adjacent to shatterproof1 (SHELL) shell thickness gene
gagcaggtaattatcctcactttcrtcctgaggaccaacaaagcgttagg

SEQ ID NO: 2523 - DNA, 50 bp, Artificial Sequence
  synthetic Elaeis guineensis (oil palm) single nucleotide polymorphism (SNP) in genomic region adjacent to shatterproof1 (SHELL) shell thickness gene
atcctcactttcatcctgaggaccracaaagcgttagggcattacatata

SEQ ID NO: 2524 - DNA, 50 bp, Artificial Sequence
  synthetic Elaeis guineensis (oil palm) single nucleotide polymorphism (SNP) in genomic region adjacent to shatterproof1 (SHELL) shell thickness gene
agtgatatttttatagtcaaaatartataccatcaggccaggctcatttt

SEQ ID NO: 2525 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatagtcaaaatagtataccatcargccaggctcattttctggcttaatc

SEQ ID NO: 2526 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgagaactcaccgtcatctgtgtcrcctgaatccagagggatgccctcat

SEQ ID NO: 2527 - DNA, 50 bp, Artificial Sequence
  synthetic Elaeis guineensis (oil palm) single nucleotide polymorphism (SNP) in genomic region adjacent to shatterproof1 (SHELL) shell thickness gene
agcaacaacatagaagggcagataytaggagggttagaggtccaatcact

SEQ ID NO: 2528 - DNA, 50 bp, Artificial Sequence
  synthetic Elaeis guineensis (oil palm) single nucleotide polymorphism (SNP) in genomic region adjacent to shatterproof1 (SHELL) shell thickness gene
ataacatattcaggtagtcactgcraagcagtttttctctatcctgaatg

SEQ ID NO: 2529 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctagatcacagtgaagcaaccttayagttgtgccatggctcatgctctag

SEQ ID NO: 2530 - DNA, 50 bp, Artificial Sequence
  synthetic Elaeis guineensis (oil palm) single nucleotide polymorphism (SNP) in genomic region adjacent to shatterproof1 (SHELL) shell thickness gene
attccattgttggatgatggtaaaytaggtgcttggttaaagcagcaaat

SEQ ID NO: 2531 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgtgcactgaggtacacatataggrccccataccaagatttaaagcatgg

SEQ ID NO: 2532 - DNA, 50 bp, Artificial Sequence
  synthetic Elaeis guineensis (oil palm) single nucleotide polymorphism (SNP) in genomic region adjacent to shatterproof1 (SHELL) shell thickness gene
attgtcccactttcaaaaaatcatmattgcagtgcaaaaatggtgttgtt

SEQ ID NO: 2533 - DNA, 50 bp, Artificial Sequence
  synthetic Elaeis guineensis (oil palm) single nucleotide polymorphism (SNP) in genomic region adjacent to shatterproof1 (SHELL) shell thickness gene
acgaagttcttgggcaacacatggkagcatcaatcgcaactggcagttta

SEQ ID NO: 2534 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctcaactatgtatatactggtactmgtagcatttgatatgcttatttttg

SEQ ID NO: 2535 - DNA, 50 bp, Artificial Sequence
  synthetic Elaeis guineensis (oil palm) single nucleotide polymorphism (SNP) in genomic region adjacent to shatterproof1 (SHELL) shell thickness gene
attttatggcattttatggcatacygtagaatataattaagcaccaaagt

SEQ ID NO: 2536 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttatcccagaaggaggttaccactwtctaaacaacatgaattattgatga

SEQ ID NO: 2537 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttaagaattttcatttcaagcatartagcttcagcaagaggaataatatt

SEQ ID NO: 2538 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaatgaataattttttctagtgatsattattttgtatttacttacctaca

SEQ ID NO: 2539 - DNA, 50 bp, Artificial Sequence
  synthetic Elaeis guineensis (oil palm) single nucleotide polymorphism (SNP) in genomic region adjacent to shatterproof1 (SHELL) shell thickness gene
atatttgcacaatctaacattattwtgaaggttgattggaatatctgaat

SEQ ID NO: 2540 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaatggaaaagaactaagcctcatrattggcagcatttacaatggagcaa

SEQ ID NO: 2541 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctacctgaaaaactattagttttmtacattctggtccactgtgagataa

SEQ ID NO: 2542 - DNA, 50 bp, Artificial Sequence
  synthetic Elaeis guineensis (oil palm) single nucleotide polymorphism (SNP) in genomic region adjacent to shatterproof1 (SHELL) shell thickness gene
atcctaacctaaatttcaatgatcrgtgtttctgcattttcaccaagcta

SEQ ID NO: 2543 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcattttcaccaagctagaacataytgtccgcgcaacaggaaagaaaatg

SEQ ID NO: 2544 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttggtgcaacacgtaggggcacckattagcagaaatcaaagaacgtcaa

SEQ ID NO: 2545 - DNA, 50 bp, Artificial Sequence
  synthetic Elaeis guineensis (oil palm) single nucleotide polymorphism (SNP) in genomic region adjacent to shatterproof1 (SHELL) shell thickness gene
cgctgaaaccctcccaacccatcayagttaacgaacaagatataaatcat

SEQ ID NO: 2546 - DNA, 50 bp, Artificial Sequence
  synthetic Elaeis guineensis (oil palm) single nucleotide polymorphism (SNP) in genomic region adjacent to shatterproof1 (SHELL) shell thickness gene
accctcccaacccatcacagttaaygaacaagatataaatcatgaacagc

SEQ ID NO: 2547 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatcgatgaaaaatatgtgattatmtaaaactaaagatccagagcaagag

SEQ ID NO: 2548 - DNA, 50 bp, Artificial Sequence
  synthetic Elaeis guineensis (oil palm) single nucleotide polymorphism (SNP) in genomic region adjacent to shatterproof1 (SHELL) shell thickness gene
actcggagtccggggaggtagcatrtaaaagaggtagagtggatccgctg

SEQ ID NO: 2549 - DNA, 50 bp, Artificial Sequence
  synthetic Elaeis guineensis (oil palm) single nucleotide polymorphism (SNP) in genomic region adjacent to shatterproof1 (SHELL) shell thickness gene
tggtagaagagaagagcagtttaaygcaaataaaatttaactctggttaa

SEQ ID NO: 2550 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcaagtaatagcatttttttcttgrtccatttgttagccattcatggtct

SEQ ID NO: 2551 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatatatttatatgagttaataaakatttttgaattaattatatattaat

SEQ ID NO: 2552 - DNA, 50 bp, Artificial Sequence
  synthetic Elaeis guineensis (oil palm) single nucleotide polymorphism (SNP) in genomic region adjacent to shatterproof1 (SHELL) shell thickness gene
caaatacaaaaaaaataaatatcayatttcttgtagtatttattttatct

SEQ ID NO: 2553 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagcttagggagtgcatgtatatayatatggagcaacatttagcatttat

SEQ ID NO: 2554 - DNA, 50 bp, Artificial Sequence
  synthetic Elaeis guineensis (oil palm) single nucleotide polymorphism (SNP) in genomic region adjacent to shatterproof1 (SHELL) shell thickness gene
ataaatatataaatattatgactamataaatatatgtatatatgcagcac

SEQ ID NO: 2555 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaataaattgaaatgtaaatcgaartagaatgacaatggaatgtggtgaa

SEQ ID NO: 2556 - DNA, 50 bp, Artificial Sequence
  synthetic Elaeis guineensis (oil palm) single nucleotide polymorphism (SNP) in genomic region adjacent to shatterproof1 (SHELL) shell thickness gene
actttttattttatattttattaawtatttattatttactatattacata

SEQ ID NO: 2557 - DNA, 50 bp, Artificial Sequence
  synthetic Elaeis guineensis (oil palm) single nucleotide polymorphism (SNP) in genomic region adjacent to shatterproof1 (SHELL) shell thickness gene
actatattacataccttatgttgcrgtcaatcccctgtagcgcctgtcgc

SEQ ID NO: 2558 - DNA, 50 bp, Artificial Sequence
  synthetic Elaeis guineensis (oil palm) single nucleotide polymorphism (SNP) in genomic region adjacent to shatterproof1 (SHELL) shell thickness gene
tccatactaatcgaaattgtatccracagagatcctctgatgctcaaata

SEQ ID NO: 2559 - DNA, 50 bp, Artificial Sequence
  synthetic Elaeis guineensis (oil palm) single nucleotide polymorphism (SNP) in genomic region adjacent to shatterproof1 (SHELL) shell thickness gene
atgacaaagtgttagctcaaaattrtcttatcaatactgttcgtttacct

SEQ ID NO: 2560 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggctataatcatagagttaatgggyggtttatgcctattgatagtcgtga

SEQ ID NO: 2561 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatgggcggtttatgcctattgatrgtcgtgacacgtagtcgatgaccat

SEQ ID NO: 2562 - DNA, 50 bp, Artificial Sequence
  synthetic Elaeis guineensis (oil palm) single nucleotide polymorphism (SNP) in genomic region adjacent to shatterproof1 (SHELL) shell thickness gene
tagtaggtcgacagtcgtggagttycgaatgagcgtcgatcgataatttt

SEQ ID NO: 2563 - DNA, 50 bp, Artificial Sequence
  synthetic Elaeis guineensis (oil palm) single nucleotide polymorphism (SNP) in genomic region adjacent to shatterproof1 (SHELL) shell thickness gene
attttgatatatcaatgatcatcartcggatattcactgagtcatcgtgg

SEQ ID NO: 2564 - DNA, 50 bp, Artificial Sequence
  synthetic Elaeis guineensis (oil palm) single nucleotide polymorphism (SNP) in genomic region adjacent to shatterproof1 (SHELL) shell thickness gene
cggttggtcaactgattgttagtcrgagtattgtgttcataaggacgatg

SEQ ID NO: 2565 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtggtctgtcacgttggacgaaagragttgtcacgtgctgtctcgagccc

SEQ ID NO: 2566 - DNA, 50 bp, Artificial Sequence
  synthetic Elaeis guineensis (oil palm) single nucleotide polymorphism (SNP) in genomic region adjacent to shatterproof1 (SHELL) shell thickness gene
gagttgtcacgtgctgtctcgagcsccgactcgactgctggtattaatga

SEQ ID NO: 2567 - DNA, 50 bp, Artificial Sequence
  synthetic Elaeis guineensis (oil palm) single nucleotide polymorphism (SNP) in genomic region adjacent to shatterproof1 (SHELL) shell thickness gene
atatgagagatcttcagctattttrctgtttcgatagctgtgaaatcatc

SEQ ID NO: 2568 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatgagagatcttcagctattttgytgtttcgatagctgtgaaatcatca

SEQ ID NO: 2569 - DNA, 50 bp, Artificial Sequence
  synthetic Elaeis guineensis (oil palm) single nucleotide polymorphism (SNP) in genomic region adjacent to shatterproof1 (SHELL) shell thickness gene
cttgatgttgccacgtgtcgatatytgaggagatccaggtttgatcgatt

SEQ ID NO: 2570 - DNA, 50 bp, Artificial Sequence
  synthetic Elaeis guineensis (oil palm) single nucleotide polymorphism (SNP) in genomic region adjacent to shatterproof1 (SHELL) shell thickness gene
gctttactttgcatttgttaacatyctcttcaacagaaggttctgctgga

SEQ ID NO: 2571 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccccagtactaggagctccagggtmttatttctcgcaccatcctttgact

SEQ ID NO: 2572 - DNA, 50 bp, Artificial Sequence
  synthetic Elaeis guineensis (oil palm) single nucleotide polymorphism (SNP) in genomic region adjacent to shatterproof1 (SHELL) shell thickness gene
atccgaacacaatgttgactggctytgggagcagtaccgtatcccggagc

SEQ ID NO: 2573 - DNA, 50 bp, Artificial Sequence
  synthetic Elaeis guineensis (oil palm) single nucleotide polymorphism (SNP) in genomic region adjacent to shatterproof1 (SHELL) shell thickness gene
atttttctcctctgggtctggtcgwaatttaatcgaggaccttcgggtcg

SEQ ID NO: 2574 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtctctgtcctgctcagttggcccygaattctatccggctaatcatcagc

SEQ ID NO: 2575 - DNA, 50 bp, Artificial Sequence
  synthetic Elaeis guineensis (oil palm) single nucleotide polymorphism (SNP) in genomic region adjacent to shatterproof1 (SHELL) shell thickness gene
atcttttatcatcgatctttcatcrtctattcatggatggaagaatcaat

SEQ ID NO: 2576 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttttatcatcgatctttcatcgtcyattcatggatggaagaatcaatttt

SEQ ID NO: 2577 - DNA, 50 bp, Artificial Sequence
  synthetic Elaeis guineensis (oil palm) single nucleotide polymorphism (SNP) in genomic region adjacent to shatterproof1 (SHELL) shell thickness gene
atcgtctattcatggatggaagaaycaatttttttttatttcttcttttt

SEQ ID NO: 2578 - DNA, 50 bp, Artificial Sequence
  synthetic Elaeis guineensis (oil palm) single nucleotide polymorphism (SNP) in genomic region adjacent to shatterproof1 (SHELL) shell thickness gene
tccaaggactggccctaacgagaayagtcggatggaggccaatgatcgaa

SEQ ID NO: 2579 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctgaaggatatggcagttttaccgyagtgagagctgatgaccgaataagc

SEQ ID NO: 2580 - DNA, 50 bp, Artificial Sequence
  synthetic Elaeis guineensis (oil palm) single nucleotide polymorphism (SNP) in genomic region adjacent to shatterproof1 (SHELL) shell thickness gene
accgctgatatccgctcgcacgtaygctaccaagaaaaaggcagcagctg

SEQ ID NO: 2581 - DNA, 50 bp, Artificial Sequence
  synthetic Elaeis guineensis (oil palm) single nucleotide polymorphism (SNP) in genomic region adjacent to shatterproof1 (SHELL) shell thickness gene
agatggttcctgagccaatcttgaygttgtcagccctgacaatgcttcct

SEQ ID NO: 2582 - DNA, 50 bp, Artificial Sequence
  synthetic Elaeis guineensis (oil palm) single nucleotide polymorphism (SNP) in genomic region adjacent to shatterproof1 (SHELL) shell thickness gene
actcttttcgacattcggatctctragggtgagtcagccttggccaatcc

SEQ ID NO: 2583 - DNA, 50 bp, Artificial Sequence
  synthetic Elaeis guineensis (oil palm) single nucleotide polymorphism (SNP) in genomic region adjacent to shatterproof1 (SHELL) shell thickness gene
agggtgagtcagccttggccaatcygacattggccaagcggcttatcgaa

SEQ ID NO: 2584 - DNA, 50 bp, Artificial Sequence
  synthetic Elaeis guineensis (oil palm) single nucleotide polymorphism (SNP) in genomic region adjacent to shatterproof1 (SHELL) shell thickness gene
gccatcctgaaaaggctggcactgkccaatgctgagttggcctccgcacg

SEQ ID NO: 2585 - DNA, 50 bp, Artificial Sequence
  synthetic Elaeis guineensis (oil palm) single nucleotide polymorphism (SNP) in genomic region adjacent to shatterproof1 (SHELL) shell thickness gene
aggggctacaccgactgaagacgamgcaccgactgcaccagaagctgctc

SEQ ID NO: 2586 - DNA, 50 bp, Artificial Sequence
  synthetic Elaeis guineensis (oil palm) single nucleotide polymorphism (SNP) in genomic region adjacent to shatterproof1 (SHELL) shell thickness gene
gagcaaggagatgaagacaacgacwggtgacaggtgtagcatttttattt

SEQ ID NO: 2587 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtttgactatcgaatatcgatcgayaagttgaatgttcgatagtaattgt

SEQ ID NO: 2588 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttatttgataaacgatagtaagccraatatccttcgaccaatcgtagtca

SEQ ID NO: 2589 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagccgaatatccttcgaccaatcrtagtcaactcggtatagtttcaatt

SEQ ID NO: 2590 - DNA, 50 bp, Artificial Sequence
  synthetic Elaeis guineensis (oil palm) single nucleotide polymorphism (SNP) in genomic region adjacent to shatterproof1 (SHELL) shell thickness gene
caattagagtcgacttttacagtaraaaattgagatatagtcggtactga

SEQ ID NO: 2591 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtactgagatacagtcggtatattratttttataataaaaattgagatat

SEQ ID NO: 2592 - DNA, 50 bp, Artificial Sequence
  synthetic Elaeis guineensis (oil palm) single nucleotide polymorphism (SNP) in genomic region adjacent to shatterproof1 (SHELL) shell thickness gene
atgtattgatttttacagtgaaaarttaaaatatagtcgataagaattga

SEQ ID NO: 2593 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttcttaggaccaaatctcctggatrgaagatcttcgggtttaacttttgc

SEQ ID NO: 2594 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggaccaaatctcctggatagaagaycttcgggtttaacttttgcattata

SEQ ID NO: 2595 - DNA, 50 bp, Artificial Sequence
  synthetic Elaeis guineensis (oil palm) single nucleotide polymorphism (SNP) in genomic region adjacent to shatterproof1 (SHELL) shell thickness gene
cttgagcttgttgtcgaacttctgraagtaagtctagattgaccctccaa

SEQ ID NO: 2596 - DNA, 50 bp, Artificial Sequence
  synthetic Elaeis guineensis (oil palm) single nucleotide polymorphism (SNP) in genomic region adjacent to shatterproof1 (SHELL) shell thickness gene
atcacttttattctataagccagaytgaatggcgatttttccattggtat

SEQ ID NO: 2597 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttgagtccatacaagattattcgrtttgtcactttcacttcaccgttgg

SEQ ID NO: 2598 - DNA, 50 bp, Artificial Sequence
  synthetic Elaeis guineensis (oil palm) single nucleotide polymorphism (SNP) in genomic region adjacent to shatterproof1 (SHELL) shell thickness gene
cttccatcttactttctgtgatttrtatcagaggtccgacttctatccat

SEQ ID NO: 2599 - DNA, 50 bp, Artificial Sequence
  synthetic Elaeis guineensis (oil palm) single nucleotide polymorphism (SNP) in genomic region adjacent to shatterproof1 (SHELL) shell thickness gene
agctgactagtcgattgatgctgtrtatttacatatttttggcatggttc

SEQ ID NO: 2600 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttagccattcatcaaaatatattgygaggccatccatatgagtcatttag

SEQ ID NO: 2601 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgattagagcgtagatcattttctycgctcttgaatatcttacttcgaca

SEQ ID NO: 2602 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctttccgatgtgctaatctgttaygatcaatctcctatagcgtccgtca

SEQ ID NO: 2603 - DNA, 50 bp, Artificial Sequence
  synthetic Elaeis guineensis (oil palm) single nucleotide polymorphism (SNP) in genomic region adjacent to shatterproof1 (SHELL) shell thickness gene
cctgcaaaatgaagtccacactgaycaaaattgtatccagtggggaccct

SEQ ID NO: 2604 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgaggagtgatgaacagcagataaraatatttgaaatggcagagtgttag

SEQ ID NO: 2605 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcataacggttaaatatgtgggttycgcatattctggcattatatgatca

SEQ ID NO: 2606 - DNA, 50 bp, Artificial Sequence
  synthetic Elaeis guineensis (oil palm) single nucleotide polymorphism (SNP) in genomic region adjacent to shatterproof1 (SHELL) shell thickness gene
tagtaggtcggtagtcgtggagttycgaatgagcatcagtcgataactct

SEQ ID NO: 2607 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcgtggagttccgaatgagcatcartcgataactctgatatgctgatggt

SEQ ID NO: 2608 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctacatttggtttctctttacttrgtatgtaatcgagatattcgtttct

SEQ ID NO: 2609 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaatcagaaattatcctcaataaaratattaccttctttatgcattatac

SEQ ID NO: 2610 - DNA, 50 bp, Artificial Sequence
  synthetic Elaeis guineensis (oil palm) single nucleotide polymorphism (SNP) in genomic region adjacent to shatterproof1 (SHELL) shell thickness gene
ataatacattaaattaaatgtttamtaaattatttattttcatttgatat

SEQ ID NO: 2611 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttgttgtggcaaatagtatttgccyctaaaaacaattttcatatataatc

SEQ ID NO: 2612 - DNA, 50 bp, Artificial Sequence
  synthetic Elaeis guineensis (oil palm) single nucleotide polymorphism (SNP) in genomic region adjacent to shatterproof1 (SHELL) shell thickness gene
atcttttaccgacttatcagtattrccgatatatagtcggtttatctgtt

SEQ ID NO: 2613 - DNA, 50 bp, Artificial Sequence
  synthetic Elaeis guineensis (oil palm) single nucleotide polymorphism (SNP) in genomic region adjacent to shatterproof1 (SHELL) shell thickness gene
ataaaagggagtaaatgagtagcaycggataaggataatttctgggtcaa

SEQ ID NO: 2614 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaagggagtaaatgagtagcaccrgataaggataatttctgggtcaaga

SEQ ID NO: 2615 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcggaggattttcgtcggacacaayttcgatctgtgaggacttgattttg

SEQ ID NO: 2616 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaggattttcgtcggacacaacttygatctgtgaggacttgattttgcag

SEQ ID NO: 2617 - DNA, 50 bp, Artificial Sequence
  synthetic Elaeis guineensis (oil palm) single nucleotide polymorphism (SNP) in genomic region adjacent to shatterproof1 (SHELL) shell thickness gene
cgtcggacacaacttcgatctgtgrggacttgattttgcaggtgctcttc

SEQ ID NO: 2618 - DNA, 50 bp, Artificial Sequence
  synthetic Elaeis guineensis (oil palm) single nucleotide polymorphism (SNP) in genomic region adjacent to shatterproof1 (SHELL) shell thickness gene
tagtaattatttaatttaattttgktgggcatgaatgtgaagctttacac

SEQ ID NO: 2619 - DNA, 50 bp, Artificial Sequence
  synthetic Elaeis guineensis (oil palm) single nucleotide polymorphism (SNP) in genomic region adjacent to shatterproof1 (SHELL) shell thickness gene
cactcttgaaggctcatgtaaaagkaattaattacgagcttggccactta

SEQ ID NO: 2620 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgtaaattgcacaacttgtacgtargagttatagttgaatagatcagtcc

SEQ ID NO: 2621 - DNA, 50 bp, Artificial Sequence
  synthetic Elaeis guineensis (oil palm) single nucleotide polymorphism (SNP) in genomic region adjacent to shatterproof1 (SHELL) shell thickness gene
tactgttgtaatgaaaataactaawattattagtcaaaaattggactttt

SEQ ID NO: 2622 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctttgttctcaaaaagaacatatarcttaaaataattgtgtttgttatta

SEQ ID NO: 2623 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgcataaactttttaggaaaaaaascaaataggataatagagtcacttta

SEQ ID NO: 2624 - DNA, 50 bp, Artificial Sequence
  synthetic Elaeis guineensis (oil palm) single nucleotide polymorphism (SNP) in genomic region adjacent to shatterproof1 (SHELL) shell thickness gene
caaggagaagcagctgaagatagayaaagcttgtgctacaacacaaaacc

SEQ ID NO: 2625 - DNA, 50 bp, Artificial Sequence
  synthetic Elaeis guineensis (oil palm) single nucleotide polymorphism (SNP) in genomic region adjacent to shatterproof1 (SHELL) shell thickness gene
taattagaaatgtcagtttgatacrttttaaaatacagaaaatgtaagtg

SEQ ID NO: 2626 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgtaagtgaaattgaattaaaattragaagatatttttataattttttta

SEQ ID NO: 2627 - DNA, 50 bp, Artificial Sequence
  synthetic Elaeis guineensis (oil palm) single nucleotide polymorphism (SNP) in genomic region adjacent to shatterproof1 (SHELL) shell thickness gene
catctccatttattatatcacactyactctctccctccctcctatttttc

SEQ ID NO: 2628 - DNA, 50 bp, Artificial Sequence
  synthetic Elaeis guineensis (oil palm) single nucleotide polymorphism (SNP) in genomic region adjacent to shatterproof1 (SHELL) shell thickness gene
gctttaatattagttggtggtttcrgttaagaaggtcaaatactttggga

SEQ ID NO: 2629 - DNA, 50 bp, Artificial Sequence
  synthetic Elaeis guineensis (oil palm) single nucleotide polymorphism (SNP) in genomic region adjacent to shatterproof1 (SHELL) shell thickness gene
gttccgaactcttcacttggaactyatgaatcaaataggctgagcttaaa

SEQ ID NO: 2630 - DNA, 50 bp, Artificial Sequence
  synthetic Elaeis guineensis (oil palm) single nucleotide polymorphism (SNP) in genomic region adjacent to shatterproof1 (SHELL) shell thickness gene
caatgcttatgctactgctgagacrtgactcagataacttggctcggtga

SEQ ID NO: 2631 - DNA, 50 bp, Artificial Sequence
  synthetic Elaeis guineensis (oil palm) single nucleotide polymorphism (SNP) in genomic region adjacent to shatterproof1 (SHELL) shell thickness gene
gataacttggctcggtgagtaggcrattatgaagtaatgttggattcatt

SEQ ID NO: 2632 - DNA, 50 bp, Artificial Sequence
  synthetic Elaeis guineensis (oil palm) single nucleotide polymorphism (SNP) in genomic region adjacent to shatterproof1 (SHELL) shell thickness gene
caattatgaagtaatgttggattcrttaatcttgttctgaattttctccc

SEQ ID NO: 2633 - DNA, 50 bp, Artificial Sequence
  synthetic Elaeis guineensis (oil palm) single nucleotide polymorphism (SNP) in genomic region adjacent to shatterproof1 (SHELL) shell thickness gene
tccatgtttagctgtaagtttatgmataattcatttatcaacgaaaagtg

SEQ ID NO: 2634 - DNA, 50 bp, Artificial Sequence
  synthetic Elaeis guineensis (oil palm) single nucleotide polymorphism (SNP) in genomic region adjacent to shatterproof1 (SHELL) shell thickness gene
gatcatccgctgttttgaacaaaasaaagaaacctttcagtatcataaat

SEQ ID NO: 2635 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgtgctacatgaaaagagctgactwatgctaagaaaatttgagagcttcc

SEQ ID NO: 2636 - DNA, 50 bp, Artificial Sequence
  synthetic Elaeis guineensis (oil palm) single nucleotide polymorphism (SNP) in genomic region adjacent to shatterproof1 (SHELL) shell thickness gene
taagaaaatttgagagcttcccacrttcatttagaggaaaatttcttgat

SEQ ID NO: 2637 - DNA, 50 bp, Artificial Sequence
  synthetic Elaeis guineensis (oil palm) single nucleotide polymorphism (SNP) in genomic region adjacent to shatterproof1 (SHELL) shell thickness gene
tggagagaagagtagggtccgagtscaagccgtcccttcttcacccagga

SEQ ID NO: 2638 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctagctcatgcatgtggtgggcctmcttatttataccagttcccacgcaa

SEQ ID NO: 2639 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagataatgaccacatggaccaaamtccttatattgagtctgtgtgatgc

SEQ ID NO: 2640 - DNA, 50 bp, Artificial Sequence
  synthetic Elaeis guineensis (oil palm) single nucleotide polymorphism (SNP) in genomic region adjacent to shatterproof1 (SHELL) shell thickness gene
agatccgatcaaatccaaaaaatargatttgatcggatttgggtaaaacc

SEQ ID NO: 2641 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccaaaaactgtagtacgggtatagrtaggatatgagtagtgctattttct

SEQ ID NO: 2642 - DNA, 50 bp, Artificial Sequence
  synthetic Elaeis guineensis (oil palm) single nucleotide polymorphism (SNP) in genomic region adjacent to shatterproof1 (SHELL) shell thickness gene
cctgatccgaacctacggatatggrtaatatccgaatccatatccaaata

SEQ ID NO: 2643 - DNA, 50 bp, Artificial Sequence
  synthetic Elaeis guineensis (oil palm) single nucleotide polymorphism (SNP) in genomic region adjacent to shatterproof1 (SHELL) shell thickness gene
atccaaatatatatgtttataattytattttggtaattctattttgattg

SEQ ID NO: 2644 - DNA, 50 bp, Artificial Sequence
  synthetic Elaeis guineensis (oil palm) single nucleotide polymorphism (SNP) in genomic region adjacent to shatterproof1 (SHELL) shell thickness gene
atatatgtttataattttattttgrtaattctattttgattgataatatg

SEQ ID NO: 2645 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctcttttcttatccgatcagatatraggtagaatttgggtatagagtatt

SEQ ID NO: 2646 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatccgatccaaaccctatccgttsccatccttactcctcattgacccat

SEQ ID NO: 2647 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttactcctcattgacccattgtgargacctatatcgatatgtatttagtc

SEQ ID NO: 2648 - DNA, 50 bp, Artificial Sequence
  synthetic Elaeis guineensis (oil palm) single nucleotide polymorphism (SNP) in genomic region adjacent to shatterproof1 (SHELL) shell thickness gene
aattatttgataggaagatctaggwtacttatacagaactgaataatcta

SEQ ID NO: 2649 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttggataagatcctggattattatwaatagaatcaaagggatccggctca

SEQ ID NO: 2650 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggctcataagtcatctggaatgggwgatattatagcacggattcattgag

SEQ ID NO: 2651 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggggtggaaccaagccgggcgctayccctatccaagcctagttcaaaaat

SEQ ID NO: 2652 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggtggaaccaagccgggcgctaccyctatccaagcctagttcaaaaataa

SEQ ID NO: 2653 - DNA, 50 bp, Artificial Sequence
  synthetic Elaeis guineensis (oil palm) single nucleotide polymorphism (SNP) in genomic region adjacent to shatterproof1 (SHELL) shell thickness gene
cgggcgctacccctatccaagcctrgttcaaaaataattttcaggcttca

SEQ ID NO: 2654 - DNA, 50 bp, Artificial Sequence
  synthetic Elaeis guineensis (oil palm) single nucleotide polymorphism (SNP) in genomic region adjacent to shatterproof1 (SHELL) shell thickness gene
atgtgtaaaaatccaggcccgagcmcaggttcgaatccatttgggttagc

SEQ ID NO: 2655 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttgggttagctcgagacattacttrgttcaagcctagctcgagctcaacc

SEQ ID NO: 2656 - DNA, 50 bp, Artificial Sequence
  synthetic Elaeis guineensis (oil palm) single nucleotide polymorphism (SNP) in genomic region adjacent to shatterproof1 (SHELL) shell thickness gene
gacattacttagttcaagcctagcycgagctcaacccaatattaatataa

SEQ ID NO: 2657 - DNA, 50 bp, Artificial Sequence
  synthetic Elaeis guineensis (oil palm) single nucleotide polymorphism (SNP) in genomic region adjacent to shatterproof1 (SHELL) shell thickness gene
gttggacgaggcctcaggccactcyttctgctacatgtgctctgccatac

SEQ ID NO: 2658 - DNA, 50 bp, Artificial Sequence
  synthetic Elaeis guineensis (oil palm) single nucleotide polymorphism (SNP) in genomic region adjacent to shatterproof1 (SHELL) shell thickness gene
tccccctctcaatctatgatgcccmgttgttgtcgccgcctagtcatagg

SEQ ID NO: 2659 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttaatagagatttgttcctcttcgrgccgattaagtagtgtgcgctctgg

SEQ ID NO: 2660 - DNA, 50 bp, Artificial Sequence
  synthetic Elaeis guineensis (oil palm) single nucleotide polymorphism (SNP) in genomic region adjacent to shatterproof1 (SHELL) shell thickness gene
cttcgggccgattaagtagtgtgcrctctggagcctattcgatgccgtac

SEQ ID NO: 2661 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcctattcgatgccgtacctttctytagcatgctcatgaagaagaagagc

SEQ ID NO: 2662 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcctctcggagaaaaaccgccaccytagatgttccccctctggagcttca

SEQ ID NO: 2663 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccccctccagaagaaacaaagaagrgaagaagaatgtgcgaacagcggtg

SEQ ID NO: 2664 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtgcgaacagcggtgctgcaattgraaaattaaatgagaagattggaatc

SEQ ID NO: 2665 - DNA, 50 bp, Artificial Sequence
  synthetic Elaeis guineensis (oil palm) single nucleotide polymorphism (SNP) in genomic region adjacent to shatterproof1 (SHELL) shell thickness gene
taggatcgcacttgcagtcgagctyaggttggggcaatggtaggcccgag

SEQ ID NO: 2666 - DNA, 50 bp, Artificial Sequence
  synthetic Elaeis guineensis (oil palm) single nucleotide polymorphism (SNP) in genomic region adjacent to shatterproof1 (SHELL) shell thickness gene
aacctacagtcgagcctatccgagyacattttcagcctcacatgcgggtg

SEQ ID NO: 2667 - DNA, 50 bp, Artificial Sequence
  synthetic Elaeis guineensis (oil palm) single nucleotide polymorphism (SNP) in genomic region adjacent to shatterproof1 (SHELL) shell thickness gene
acatcagttatttgctggaaagatyttaaatatttatatagaatcgagaa

SEQ ID NO: 2668 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctggaaagattttaaatatttatayagaatcgagaaattcaaataatatc

SEQ ID NO: 2669 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaaagattttaaatatttatatagratcgagaaattcaaataatatcttg

SEQ ID NO: 2670 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatatttatatagaatcgagaaatycaaataatatcttgtgactaatctt

SEQ ID NO: 2671 - DNA, 50 bp, Artificial Sequence
  synthetic Elaeis guineensis (oil palm) single nucleotide polymorphism (SNP) in genomic region adjacent to shatterproof1 (SHELL) shell thickness gene
attctatagccaatcaataataaaytgtttggcatcattgttcttatgtt

SEQ ID NO: 2672 - DNA, 50 bp, Artificial Sequence
  synthetic Elaeis guineensis (oil palm) single nucleotide polymorphism (SNP) in genomic region adjacent to shatterproof1 (SHELL) shell thickness gene
attgtttggcatcattgttcttatktttttttctttcaacaaattaatca

SEQ ID NO: 2673 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttggaagctcaaaaattttacaaayaatttcaagaaaaaagaaaggttcc

SEQ ID NO: 2674 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaatcaacacactagctgcctaagytgagctgactgtccaaaatgaaaat

SEQ ID NO: 2675 - DNA, 50 bp, Artificial Sequence
  synthetic Elaeis guineensis (oil palm) single nucleotide polymorphism (SNP) in genomic region adjacent to shatterproof1 (SHELL) shell thickness gene
gatggtttacatagactggatgcartacagcaaatatcatccattaactt

SEQ ID NO: 2676 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcatactggttaaaataggctgatrtctagaatatcattgaaccttagcc

SEQ ID NO: 2677 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaataggctgatatctagaatatcrttgaaccttagccaggcaatgttcc

SEQ ID NO: 2678 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagctcatttgcaaatttacttcaygattttttgatggattgataatagt

SEQ ID NO: 2679 - DNA, 50 bp, Artificial Sequence
  synthetic Elaeis guineensis (oil palm) single nucleotide polymorphism (SNP) in genomic region adjacent to shatterproof1 (SHELL) shell thickness gene
taatagtttgccataaatctttcaragtttcatataaattggcaactaca

SEQ ID NO: 2680 - DNA, 50 bp, Artificial Sequence
  synthetic Elaeis guineensis (oil palm) single nucleotide polymorphism (SNP) in genomic region adjacent to shatterproof1 (SHELL) shell thickness gene
atctttcagagtttcatataaattkgcaactacagacaaattaatgcact

SEQ ID NO: 2681 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcaaaatgcttgcggcagaagaackgaaagacgtctttgggtgggtttgg

SEQ ID NO: 2682 - DNA, 50 bp, Artificial Sequence
  synthetic Elaeis guineensis (oil palm) single nucleotide polymorphism (SNP) in genomic region adjacent to shatterproof1 (SHELL) shell thickness gene
gttttgaacctaatggaacaggacwaacctgaaaaataagcccatttatt

SEQ ID NO: 2683 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccatttattaaaaggataggtctcrgcttggggattaaagcttggcccag

SEQ ID NO: 2684 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgaaccacgaaaagcctgctagacrtttccatttcttttaaaaaaatagc

SEQ ID NO: 2685 - DNA, 50 bp, Artificial Sequence
  synthetic Elaeis guineensis (oil palm) single nucleotide polymorphism (SNP) in genomic region adjacent to shatterproof1 (SHELL) shell thickness gene
caatataacaacttttcggctataragctgaacaaaatcaccactttttc

SEQ ID NO: 2686 - DNA, 50 bp, Artificial Sequence
  synthetic Elaeis guineensis (oil palm) single nucleotide polymorphism (SNP) in genomic region adjacent to shatterproof1 (SHELL) shell thickness gene
cgatacgtgactgtaaaggcaaaaraaaaaggtatcacaaagaatatata

SEQ ID NO: 2687 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttccatcatcactaacaacctatwaaatgcaaaaggcatggtgtatcag

SEQ ID NO: 2688 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatgtatcagtgacactagtgccascaactagcaaactgctgtagaactt

SEQ ID NO: 2689 - DNA, 50 bp, Artificial Sequence
  synthetic Elaeis guineensis (oil palm) single nucleotide polymorphism (SNP) in genomic region adjacent to shatterproof1 (SHELL) shell thickness gene
acttttctatatgaaagttacaagrgattttgaatgaggaacaaaatgca

SEQ ID NO: 2690 - DNA, 50 bp, Artificial Sequence
  synthetic Elaeis guineensis (oil palm) single nucleotide polymorphism (SNP) in genomic region adjacent to shatterproof1 (SHELL) shell thickness gene
caacatgcaaccagttatggaaagmagttgttgggaaggcatatgatcaa

SEQ ID NO: 2691 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttaagaaaatagaggggatgagtgkccccctaattgctctgaccattata

SEQ ID NO: 2692 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaagaaaactccacctccacctacmaaagccagtttacacctaatccatt

SEQ ID NO: 2693 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgttgaatgtagcggatcactaagygtagtcacattgcaatggatcgtca

SEQ ID NO: 2694 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcttatgagtcaacagtcttgtaaygcaatgacatgtacataacatcttg

SEQ ID NO: 2695 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctcaaatctctcatctcccatctytctttttcttatccctaaagttcca

SEQ ID NO: 2696 - DNA, 50 bp, Artificial Sequence
  synthetic Elaeis guineensis (oil palm) single nucleotide polymorphism (SNP) in genomic region adjacent to shatterproof1 (SHELL) shell thickness gene
catccttctttgctcggttcttctyctccactcgtctcccatcatctcct

SEQ ID NO: 2697 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccaacacctctcactaagccagcaycaatttcattgtcttctcctcccat

SEQ ID NO: 2698 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagaagagaaactgaaagataatcrgagaagaaaaaagaaaaataagatt

SEQ ID NO: 2699 - DNA, 50 bp, Artificial Sequence
  synthetic Elaeis guineensis (oil palm) single nucleotide polymorphism (SNP) in genomic region adjacent to shatterproof1 (SHELL) shell thickness gene
atcaatggttgtcacatcagacttycaatgaaagaaagccatcagaatag

SEQ ID NO: 2700 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcaaggactaaactttagctttttrtaatttagagattttttaagaatat

SEQ ID NO: 2701 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgatgattggaaggcttaaatttgrccacttgtttatttatataagcggt

SEQ ID NO: 2702 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggctcaacctaattttgcatgaatrttgaagaactcattgtttgtgggtt

SEQ ID NO: 2703 - DNA, 50 bp, Artificial Sequence
  synthetic Elaeis guineensis (oil palm) single nucleotide polymorphism (SNP) in genomic region adjacent to shatterproof1 (SHELL) shell thickness gene
agtttaagtgacttgtgaatttggycgtggactaaaatgattcgagtctc

SEQ ID NO: 2704 - DNA, 50 bp, Artificial Sequence
  synthetic Elaeis guineensis (oil palm) single nucleotide polymorphism (SNP) in genomic region adjacent to shatterproof1 (SHELL) shell thickness gene
actccttttatatgggatcaagtartagaattggccatgtttggagcagc

SEQ ID NO: 2705 - DNA, 50 bp, Artificial Sequence
  synthetic Elaeis guineensis (oil palm) single nucleotide polymorphism (SNP) in genomic region adjacent to shatterproof1 (SHELL) shell thickness gene
tggaagaattgattctatttctgtracgcataagtagttctgctcaatgt

SEQ ID NO: 2706 - DNA, 50 bp, Artificial Sequence
  synthetic Elaeis guineensis (oil palm) single nucleotide polymorphism (SNP) in genomic region adjacent to shatterproof1 (SHELL) shell thickness gene
gttctgctcaatgtgcatcacatcyaagtatatatcacaagtatatggat

SEQ ID NO: 2707 - DNA, 50 bp, Artificial Sequence
  synthetic Elaeis guineensis (oil palm) single nucleotide polymorphism (SNP) in genomic region adjacent to shatterproof1 (SHELL) shell thickness gene
aactaattgacccaaagtttaacargtagtactcttcaacaatctattaa

SEQ ID NO: 2708 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtgcctaacatcttataaattttcmatcatgataattgtttattttggta

SEQ ID NO: 2709 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtaaagtacttatgtatatacacayataaaatatacaacaagagttgcat

SEQ ID NO: 2710 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggctgtgtccaagtaatttcgatgyagccgtcagcaaagtccaatttacc

SEQ ID NO: 2711 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatttcgatgtagccgtcagcaaastccaatttaccttagattgatggct

SEQ ID NO: 2712 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggcccaaatcttataaaatatgagraggcatttttaaaccaaatccgttg

SEQ ID NO: 2713 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaatccgttgaaaaatccaaacatrcccttgagaacatgtttggatatct

SEQ ID NO: 2714 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttcctttaagaaaataagaaaccayaatagtaaacagaagaaaactgaca

SEQ ID NO: 2715 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcctttaagaaaataagaaaccatratagtaaacagaagaaaactgacat

SEQ ID NO: 2716 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgataggttgtagaatagatgatgyagctatacaatcatggcaaaaggct

SEQ ID NO: 2717 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcgaggaggagggcagtaagatatrgacagcgtgggaggaggtggcgaga

SEQ ID NO: 2718 - DNA, 50 bp, Artificial Sequence
  synthetic Elaeis guineensis (oil palm) single nucleotide polymorphism (SNP) in genomic region adjacent to shatterproof1 (SHELL) shell thickness gene
aggtggcgagagggtagagaagtgrgaggaggaggagggagagggtgcgc

SEQ ID NO: 2719 - DNA, 50 bp, Artificial Sequence
  synthetic Elaeis guineensis (oil palm) single nucleotide polymorphism (SNP) in genomic region adjacent to shatterproof1 (SHELL) shell thickness gene
atcctattcttcccaaactggctcyaaaaagctcaaaaggcttggcctgc

SEQ ID NO: 2720 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctctactagtgtaatataataatgygaagatcatgctaatataggataat

SEQ ID NO: 2721 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgtgtaaatgctgttttgcaggtgstcgttaccgatgacagaggacgggg

SEQ ID NO: 2722 - DNA, 50 bp, Artificial Sequence
  synthetic Elaeis guineensis (oil palm) single nucleotide polymorphism (SNP) in genomic region adjacent to shatterproof1 (SHELL) shell thickness gene
taaatagcggacgacttgagctgayggtatgacaaaattatcaaccgacg

SEQ ID NO: 2723 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctgctcaacatgccataccgtcacraatggttatcgaccgcatatcacgg

SEQ ID NO: 2724 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccacttttgatcagagctctgctayactgaatattcaacaactactgttc

SEQ ID NO: 2725 - DNA, 50 bp, Artificial Sequence
  synthetic Elaeis guineensis (oil palm) single nucleotide polymorphism (SNP) in genomic region adjacent to shatterproof1 (SHELL) shell thickness gene
aacaactactgttcaccaacttttytctctgacttaagcatcgaaggatc

SEQ ID NO: 2726 - DNA, 50 bp, Artificial Sequence
  synthetic Elaeis guineensis (oil palm) single nucleotide polymorphism (SNP) in genomic region adjacent to shatterproof1 (SHELL) shell thickness gene
cttttctctctgacttaagcatcgraggatccccgccggacaccattccg

SEQ ID NO: 2727 - DNA, 50 bp, Artificial Sequence
  synthetic Elaeis guineensis (oil palm) single nucleotide polymorphism (SNP) in genomic region adjacent to shatterproof1 (SHELL) shell thickness gene
atgctgttttgcgggtgctcgttascggcgacaggcgacggagagttggc

SEQ ID NO: 2728 - DNA, 50 bp, Artificial Sequence
  synthetic Elaeis guineensis (oil palm) single nucleotide polymorphism (SNP) in genomic region adjacent to shatterproof1 (SHELL) shell thickness gene
ataaggagaaaaaaattcttcccayatgaggtaccttttaaaggacaaaa

SEQ ID NO: 2729 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtggacaatacctcacatgacggaycgagcctttgtccgcaacaatggcg

SEQ ID NO: 2730 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccgcaacaatggcgcgccacattgrttgtgagtcaagagagactcgcact

SEQ ID NO: 2731 - DNA, 50 bp, Artificial Sequence
  synthetic Elaeis guineensis (oil palm) single nucleotide polymorphism (SNP) in genomic region adjacent to shatterproof1 (SHELL) shell thickness gene
atagattccaaacagaaccataatrtgaccttatcacattaacttgggtt

SEQ ID NO: 2732 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccttatcacattaacttgggtttayagtggaagagaatggagagatggtg

SEQ ID NO: 2733 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagagaatggagagatggtgaatayacttctatcagagcaaggaataaat

SEQ ID NO: 2734 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttatatcccaatgatatgatatggraataatgtgcaggaataatggtagg

SEQ ID NO: 2735 - DNA, 50 bp, Artificial Sequence
  synthetic Elaeis guineensis (oil palm) single nucleotide polymorphism (SNP) in genomic region adjacent to shatterproof1 (SHELL) shell thickness gene
atgatatgatatgggaataatgtgyaggaataatggtaggcatataaaaa

SEQ ID NO: 2736 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagcattgaaaaaaatagtaaaatrgaataagcaagcatcgcatatcaca

SEQ ID NO: 2737 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaaacacaagaatttatatcagtayagtataaagttcaaccaatgatata

SEQ ID NO: 2738 - DNA, 50 bp, Artificial Sequence
  synthetic Elaeis guineensis (oil palm) single nucleotide polymorphism (SNP) in genomic region adjacent to shatterproof1 (SHELL) shell thickness gene
gatatatgggcatatttaaccaagrtttcttgtaccggtaccggtggccg

SEQ ID NO: 2739 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaatcctagaattccaagttctgtwttcttgtccgaacacattcatgctc

SEQ ID NO: 2740 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtcagagaatatatcaatgctcacytgtcaagaacacaaataatggtatt

SEQ ID NO: 2741 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttcacaacctctttcacgaagcccycttcttccccttcagcgaactccac

SEQ ID NO: 2742 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctctttcacgaagccctcttcttcyccttcagcgaactccacctgaacca

SEQ ID NO: 2743 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaccagccaaatgaacgtgactccrgcgacgaagaatgggttccggttga

SEQ ID NO: 2744 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggagaggaatcatgaggcaagacgmgagggaaagaaagagaaaatgcgga

SEQ ID NO: 2745 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgggaggaatttctccaggttttasagtttgaatcaccagtaaaacatga

SEQ ID NO: 2746 - DNA, 50 bp, Artificial Sequence
  synthetic Elaeis guineensis (oil palm) single nucleotide polymorphism (SNP) in genomic region adjacent to shatterproof1 (SHELL) shell thickness gene
aacggtcactaggatctggttgttrtagaccccttatcctctcccacttc

SEQ ID NO: 2747 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctagtcttatggtgaagggcaggmagaaaatgttagtgctagctttgtc

SEQ ID NO: 2748 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaaaatgttagtgctagctttgtcmcgagagatcatcaaggaagagccat

SEQ ID NO: 2749 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcatcaaggaagagccattctcagrgctggtcaacttcggggagcttggg

SEQ ID NO: 2750 - DNA, 50 bp, Artificial Sequence
  synthetic Elaeis guineensis (oil palm) single nucleotide polymorphism (SNP) in genomic region adjacent to shatterproof1 (SHELL) shell thickness gene
aacttcggggagcttgggaaggtgyaagtgcattctttcatttggatcat

SEQ ID NO: 2751 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttaggtcaatggtgcaaaataaaarctaaaggtgatgaaaagctgacttc

SEQ ID NO: 2752 - DNA, 50 bp, Artificial Sequence
  synthetic Elaeis guineensis (oil palm) single nucleotide polymorphism (SNP) in genomic region adjacent to shatterproof1 (SHELL) shell thickness gene
atgtgtaacaatcgatacttcaaakgtgtcagaattttggaccatccaat

SEQ ID NO: 2753 - DNA, 50 bp, Artificial Sequence
  synthetic Elaeis guineensis (oil palm) single nucleotide polymorphism (SNP) in genomic region adjacent to shatterproof1 (SHELL) shell thickness gene
aacaatcgatacttcaaaggtgtcrgaattttggaccatccaatagctga

SEQ ID NO: 2754 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatgattcaaacttgtagtatttgycaattgcaaaaagatcaccctggtt

SEQ ID NO: 2755 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgattcaaacttgtagtatttgtcrattgcaaaaagatcaccctggttag

SEQ ID NO: 2756 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaagatcaccctggttagacatgsttagtttaatcatgccttcattcaa

SEQ ID NO: 2757 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgccttcattcaacactagggcagygagcaaagtatgtgattgctcacat

SEQ ID NO: 2758 - DNA, 50 bp, Artificial Sequence
  synthetic Elaeis guineensis (oil palm) single nucleotide polymorphism (SNP) in genomic region adjacent to shatterproof1 (SHELL) shell thickness gene
catgagaatcattgctgattgtccygtatttcaaattgtcatccaacttt

SEQ ID NO: 2759 - DNA, 50 bp, Artificial Sequence
  synthetic Elaeis guineensis (oil palm) single nucleotide polymorphism (SNP) in genomic region adjacent to shatterproof1 (SHELL) shell thickness gene
accaaaacagagtaaccttttgacktgcacacagtcaatagaaggtttgt

SEQ ID NO: 2760 - DNA, 50 bp, Artificial Sequence
  synthetic Elaeis guineensis (oil palm) single nucleotide polymorphism (SNP) in genomic region adjacent to shatterproof1 (SHELL) shell thickness gene
caaaagaatctgcagtaaattgcayatatgagcttcttataagaaaagat

SEQ ID NO: 2761 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccagaaatgtgaaataatttgcatytggcaatgaggaagaccactggcat

SEQ ID NO: 2762 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagagaagctcatgtatatgtcatyattcatctcaattgtacatttctga

SEQ ID NO: 2763 - DNA, 50 bp, Artificial Sequence
  synthetic Elaeis guineensis (oil palm) single nucleotide polymorphism (SNP) in genomic region adjacent to shatterproof1 (SHELL) shell thickness gene
aactaatttaggtaaatagtttggstgtttgagtatcaagtgagaaataa

SEQ ID NO: 2764 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcattcatagggcagtatgctgttwacagcttattacatagacagtctgc

SEQ ID NO: 2765 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaaatagaatccatgattaaaaatyaaatttaagaacttgtcgaattgct

SEQ ID NO: 2766 - DNA, 50 bp, Artificial Sequence
  synthetic Elaeis guineensis (oil palm) single nucleotide polymorphism (SNP) in genomic region adjacent to shatterproof1 (SHELL) shell thickness gene
gttagatgccatgaaagatgaaatrgaatccatgattaaaaatcaaattt

SEQ ID NO: 2767 - DNA, 50 bp, Artificial Sequence
  synthetic Elaeis guineensis (oil palm) single nucleotide polymorphism (SNP) in genomic region adjacent to shatterproof1 (SHELL) shell thickness gene
gatattgagataaaagatgatccartctcatttaaggatactttgaatag

SEQ ID NO: 2768 - DNA, 50 bp, Artificial Sequence
  synthetic Elaeis guineensis (oil palm) single nucleotide polymorphism (SNP) in genomic region adjacent to shatterproof1 (SHELL) shell thickness gene
aacagactatcaatgagcttgatcygattaaaaataatcataataatgat

SEQ ID NO: 2769 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgaaccgtataatatggtgttacaraaaataaaaaaatctcttcctatta

SEQ ID NO: 2770 - DNA, 50 bp, Artificial Sequence
  synthetic Elaeis guineensis (oil palm) single nucleotide polymorphism (SNP) in genomic region adjacent to shatterproof1 (SHELL) shell thickness gene
taggttcattgaggatggtgaaaayagtggaagtagtgaaccgtataata

SEQ ID NO: 2771 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaaaatcgctatgtatatcttaaaycggatacttagtaaggtcgtttcta

SEQ ID NO: 2772 - DNA, 50 bp, Artificial Sequence
  synthetic Elaeis guineensis (oil palm) single nucleotide polymorphism (SNP) in genomic region adjacent to shatterproof1 (SHELL) shell thickness gene
acagcatagcattgtaacacagtayactatgtcagaaaatctccaacaaa

SEQ ID NO: 2773 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaatcaattagatagaaaaattaygattatgagatctgatagggatggt

SEQ ID NO: 2774 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctcgcattgtggttatatttttctrttgcatgaaaaatttgaagctttga

SEQ ID NO: 2775 - DNA, 50 bp, Artificial Sequence
  synthetic Elaeis guineensis (oil palm) single nucleotide polymorphism (SNP) in genomic region adjacent to shatterproof1 (SHELL) shell thickness gene
gatacataccgatatttgtggctaytttatatcttattttggagtggcaa

SEQ ID NO: 2776 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaataaattaaaagatataaaaagyatgccactagaagtcaaaaattctt

SEQ ID NO: 2777 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaataaattaaaagatataaaaarcatgccactagaagtcaaaaattct

SEQ ID NO: 2778 - DNA, 50 bp, Artificial Sequence
  synthetic Elaeis guineensis (oil palm) single nucleotide polymorphism (SNP) in genomic region adjacent to shatterproof1 (SHELL) shell thickness gene
taaattaataaaaaaaattattttrgttgttataggaatattgtgcaata

SEQ ID NO: 2779 - DNA, 50 bp, Artificial Sequence
  synthetic Elaeis guineensis (oil palm) single nucleotide polymorphism (SNP) in genomic region adjacent to shatterproof1 (SHELL) shell thickness gene
cagttgggacctacagatttattayagatattggattccaattagatcta

SEQ ID NO: 2780 - DNA, 50 bp, Artificial Sequence
  synthetic Elaeis guineensis (oil palm) single nucleotide polymorphism (SNP) in genomic region adjacent to shatterproof1 (SHELL) shell thickness gene
gctgctattcatgtttacaactcawtacagggattcctttcaagtcgaaa

SEQ ID NO: 2781 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaaaagaaggatattctcttatcayttatttgtttcaaaattaattttat

SEQ ID NO: 2782 - DNA, 50 bp, Artificial Sequence
  synthetic Elaeis guineensis (oil palm) single nucleotide polymorphism (SNP) in genomic region adjacent to shatterproof1 (SHELL) shell thickness gene
attaaaatattttttctataacaargagggacatatcaagaaggattgta

SEQ ID NO: 2783 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctcataaattaaaatattttttctrtaacaaggagggacatatcaagaag

SEQ ID NO: 2784 - DNA, 50 bp, Artificial Sequence
  synthetic Elaeis guineensis (oil palm) single nucleotide polymorphism (SNP) in genomic region adjacent to shatterproof1 (SHELL) shell thickness gene
agattgaaacatgaaggggtcccarttattcatgtggtttcacaggagca

SEQ ID NO: 2785 - DNA, 50 bp, Artificial Sequence
  synthetic Elaeis guineensis (oil palm) single nucleotide polymorphism (SNP) in genomic region adjacent to shatterproof1 (SHELL) shell thickness gene
atctcctagtgtgtgcaagaggaaraaagattgaaacatgaaggggtccc

SEQ ID NO: 2786 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatagtttatcagatcaagtaaagycttagctggtatcttaatgaacaag

SEQ ID NO: 2787 - DNA, 50 bp, Artificial Sequence
  synthetic Elaeis guineensis (oil palm) single nucleotide polymorphism (SNP) in genomic region adjacent to shatterproof1 (SHELL) shell thickness gene
agtttcacagcgagagatattaggrgatctgtttctgataacgaattggc

SEQ ID NO: 2788 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctttcatgattattaagagtttcayagcgagagatattaggagatctgtt

SEQ ID NO: 2789 - DNA, 50 bp, Artificial Sequence
  synthetic Elaeis guineensis (oil palm) single nucleotide polymorphism (SNP) in genomic region adjacent to shatterproof1 (SHELL) shell thickness gene
gagcattctaatagattatctttcrtgattattaagagtttcacagcgag

SEQ ID NO: 2790 - DNA, 50 bp, Artificial Sequence
  synthetic Elaeis guineensis (oil palm) single nucleotide polymorphism (SNP) in genomic region adjacent to shatterproof1 (SHELL) shell thickness gene
cttttacttatagttatgacccccrttttactctcatcgcatttatctaa

SEQ ID NO: 2791 - DNA, 50 bp, Artificial Sequence
  synthetic Elaeis guineensis (oil palm) single nucleotide polymorphism (SNP) in genomic region adjacent to shatterproof1 (SHELL) shell thickness gene
catcatgatcgtaattatgagcatrttcttttacttatagttatgacccc

SEQ ID NO: 2792 - DNA, 50 bp, Artificial Sequence
  synthetic Elaeis guineensis (oil palm) single nucleotide polymorphism (SNP) in genomic region adjacent to shatterproof1 (SHELL) shell thickness gene
atgttttatagttgtataataagtrttattagcagaattgtgttagaaaa

SEQ ID NO: 2793 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaatatataactaatatgatggatyatagtttaaatatgaattatatgta

SEQ ID NO: 2794 - DNA, 50 bp, Artificial Sequence
  synthetic Elaeis guineensis (oil palm) single nucleotide polymorphism (SNP) in genomic region adjacent to shatterproof1 (SHELL) shell thickness gene
aattacataaagatggagaattctrcattcaaagatgggaataacctaga

SEQ ID NO: 2795 - DNA, 50 bp, Artificial Sequence
  synthetic Elaeis guineensis (oil palm) single nucleotide polymorphism (SNP) in genomic region adjacent to shatterproof1 (SHELL) shell thickness gene
gacccaaaggttactgtaatttgakacaaaattaatagcaataggttagc

SEQ ID NO: 2796 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtcattgagggctgatgattttttytctcattatagttttaaaattacat

SEQ ID NO: 2797 - DNA, 50 bp, Artificial Sequence
  synthetic Elaeis guineensis (oil palm) single nucleotide polymorphism (SNP) in genomic region adjacent to shatterproof1 (SHELL) shell thickness gene
tattgtaatattcaagtgtattttygcatagccccaaagggctcggagca

SEQ ID NO: 2798 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatttgataattttgctcattattrtaatattcaagtgtatttttgcata

SEQ ID NO: 2799 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccgatttgagcatttttttgaaccrttggactcatgatggcttgaagaat

SEQ ID NO: 2800 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaaataattatcttatagaaaagtyccttttttgtctgagatttacgatt

SEQ ID NO: 2801 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgacatagtttattacagaaaaatycctgaagttttctgacagacttatt

SEQ ID NO: 2802 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccctgacatagtttattacagaaaratccctgaagttttctgacagactt

SEQ ID NO: 2803 - DNA, 50 bp, Artificial Sequence
  synthetic Elaeis guineensis (oil palm) single nucleotide polymorphism (SNP) in genomic region adjacent to shatterproof1 (SHELL) shell thickness gene
taaaattattttgcaaataaacccytgacatagtttattacagaaaaatc

SEQ ID NO: 2804 - DNA, 50 bp, Artificial Sequence
  synthetic Elaeis guineensis (oil palm) single nucleotide polymorphism (SNP) in genomic region adjacent to shatterproof1 (SHELL) shell thickness gene
cgaacccataatagcctttcgggtyttaggtttgatccattaaggtttca

SEQ ID NO: 2805 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcttcttgtcttcagtggctggggkggataggggcggcgctcgaccgctc

SEQ ID NO: 2806 - DNA, 50 bp, Artificial Sequence
  synthetic Elaeis guineensis (oil palm) single nucleotide polymorphism (SNP) in genomic region adjacent to shatterproof1 (SHELL) shell thickness gene
cgcggtgtctccgtgtggctatgaraaatcatggcttctaccatggcgat

SEQ ID NO: 2807 - DNA, 50 bp, Artificial Sequence
  synthetic Elaeis guineensis (oil palm) single nucleotide polymorphism (SNP) in genomic region adjacent to shatterproof1 (SHELL) shell thickness gene
cggcagtgggagccaccaccgcacrcggtgtctccgtgtggctatgaaaa

SEQ ID NO: 2808 - DNA, 50 bp, Artificial Sequence
  synthetic Elaeis guineensis (oil palm) single nucleotide polymorphism (SNP) in genomic region adjacent to shatterproof1 (SHELL) shell thickness gene
gggtcgccggcggagggggagctcytgctccccgacggcagtgggagcca

SEQ ID NO: 2809 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttaaaattatttttttatatttttyaaaataaaataagatttaaaaaatt

SEQ ID NO: 2810 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttgcataaatatcagagtacgatcyagatataaaggaattaaattatcta

SEQ ID NO: 2811 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatcatcatattggcaagatgacgrcggaaggtatagtttacttatgatt

SEQ ID NO: 2812 - DNA, 50 bp, Artificial Sequence
  synthetic Elaeis guineensis (oil palm) single nucleotide polymorphism (SNP) in genomic region adjacent to shatterproof1 (SHELL) shell thickness gene
aactctttggatcagccatatatcmtgaatcaattatagtaagcctaatt

SEQ ID NO: 2813 - DNA, 50 bp, Artificial Sequence
  synthetic Elaeis guineensis (oil palm) single nucleotide polymorphism (SNP) in genomic region adjacent to shatterproof1 (SHELL) shell thickness gene
attcataatatgatctaattatcawttaatcagatttaactctttggatc

SEQ ID NO: 2814 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgattcataatatgatctaattatyaattaatcagatttaactctttgga

SEQ ID NO: 2815 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggtatataaaaatattggatttgaytcataatatgatctaattatcaatt

SEQ ID NO: 2816 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctatcttgcttctttttccttgtcygatggattctacacaagcctttata

SEQ ID NO: 2817 - DNA, 50 bp, Artificial Sequence
  synthetic Elaeis guineensis (oil palm) single nucleotide polymorphism (SNP) in genomic region adjacent to shatterproof1 (SHELL) shell thickness gene
acaagttaatgagaattattttttrtgtactatcttgcttctttttcctt

SEQ ID NO: 2818 - DNA, 50 bp, Artificial Sequence
  synthetic Elaeis guineensis (oil palm) single nucleotide polymorphism (SNP) in genomic region adjacent to shatterproof1 (SHELL) shell thickness gene
tagaacctgataaatgtgtctcttractttctcaagatgatatttagaat

SEQ ID NO: 2819 - DNA, 50 bp, Artificial Sequence
  synthetic Elaeis guineensis (oil palm) single nucleotide polymorphism (SNP) in genomic region adjacent to shatterproof1 (SHELL) shell thickness gene
acaagagattatgcgaaagaatatractttctactgaaagagagaggaaa

SEQ ID NO: 2820 - DNA, 50 bp, Artificial Sequence
  synthetic Elaeis guineensis (oil palm) single nucleotide polymorphism (SNP) in genomic region adjacent to shatterproof1 (SHELL) shell thickness gene
tagaaagaatacaagagattatgcraaagaatatgactttctactgaaag

SEQ ID NO: 2821 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttccaccaagtcctagagatcttgygatatgaagagcatcctcatttgga

SEQ ID NO: 2822 - DNA, 50 bp, Artificial Sequence
  synthetic Elaeis guineensis (oil palm) single nucleotide polymorphism (SNP) in genomic region adjacent to shatterproof1 (SHELL) shell thickness gene
cttgattctatgccccgaaagcttytggagtacttgctggttcttcatag

SEQ ID NO: 2823 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctggatgaagagtaaggccttcgcwttcttctttttgcactccctatact

SEQ ID NO: 2824 - DNA, 50 bp, Artificial Sequence
  synthetic Elaeis guineensis (oil palm) single nucleotide polymorphism (SNP) in genomic region adjacent to shatterproof1 (SHELL) shell thickness gene
tattctatcggagccttgaaaatcytttttttaaatttttcatgcatctt

SEQ ID NO: 2825 - DNA, 50 bp, Artificial Sequence
  synthetic Elaeis guineensis (oil palm) single nucleotide polymorphism (SNP) in genomic region adjacent to shatterproof1 (SHELL) shell thickness gene
tccctccacaaagattgaagcttgmtacaagttattctatcggagccttg

SEQ ID NO: 2826 - DNA, 50 bp, Artificial Sequence
  synthetic Elaeis guineensis (oil palm) single nucleotide polymorphism (SNP) in genomic region adjacent to shatterproof1 (SHELL) shell thickness gene
agctggcaactcttaaaattttttrgacaattttgcattctggaataata

SEQ ID NO: 2827 - DNA, 50 bp, Artificial Sequence
  synthetic Elaeis guineensis (oil palm) single nucleotide polymorphism (SNP) in genomic region adjacent to shatterproof1 (SHELL) shell thickness gene
caaatttagctggcaactcttaaawttttttagacaattttgcattctgg

SEQ ID NO: 2828 - DNA, 50 bp, Artificial Sequence
  synthetic Elaeis guineensis (oil palm) single nucleotide polymorphism (SNP) in genomic region adjacent to shatterproof1 (SHELL) shell thickness gene
cccattagttcatgcaaggagaaargagataaatcctttgattcttcaat

SEQ ID NO: 2829 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaggcgaacctgttcattctttccycatgtgctttaagagagcccattag

SEQ ID NO: 2830 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctgtttatgcctatctttttgcctkgagcttccaaaaaatttggcttcca

SEQ ID NO: 2831 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttcttgcaaataaaacattaagatraggaattaccatttcttgggttact

SEQ ID NO: 2832 - DNA, 50 bp, Artificial Sequence
  synthetic Elaeis guineensis (oil palm) single nucleotide polymorphism (SNP) in genomic region adjacent to shatterproof1 (SHELL) shell thickness gene
catttaaaatgataatttcttgatycatgcccaaacttcttgcaaataaa

SEQ ID NO: 2833 - DNA, 50 bp, Artificial Sequence
  synthetic Elaeis guineensis (oil palm) single nucleotide polymorphism (SNP) in genomic region adjacent to shatterproof1 (SHELL) shell thickness gene
attctttatactaacaatccctctsagaaagatttggaattttgcatctt

SEQ ID NO: 2834 - DNA, 50 bp, Artificial Sequence
  synthetic Elaeis guineensis (oil palm) single nucleotide polymorphism (SNP) in genomic region adjacent to shatterproof1 (SHELL) shell thickness gene
atttgcttcattaggttgccttttrttctttatactaacaatccctctca

SEQ ID NO: 2835 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccacacctctgccttcaacttattrtagtttgccatctctaagcttgatt

SEQ ID NO: 2836 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgaagtcattttgatcttagcaatracaatatctttcttcttatcaagaa

SEQ ID NO: 2837 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaatcttgtttgaagtcattttgawcttagcaataacaatatctttcttc

SEQ ID NO: 2838 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttcaagcctttatagttgagctgaycatatctcaaatgccataagtaaga

SEQ ID NO: 2839 - DNA, 50 bp, Artificial Sequence
  synthetic Elaeis guineensis (oil palm) single nucleotide polymorphism (SNP) in genomic region adjacent to shatterproof1 (SHELL) shell thickness gene
caacttcaagcctttatagttgagytgatcatatctcaaatgccataagt

SEQ ID NO: 2840 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaagcccaattaccatatttttatytttcaacaacttcaagcctttatag

SEQ ID NO: 2841 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccaagccctcttggaaatggaagcygatgcagttttccataaacacaacc

SEQ ID NO: 2842 - DNA, 50 bp, Artificial Sequence
  synthetic Elaeis guineensis (oil palm) single nucleotide polymorphism (SNP) in genomic region adjacent to shatterproof1 (SHELL) shell thickness gene
tccaagccctcttggaaatggaagycgatgcagttttccataaacacaac

SEQ ID NO: 2843 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggcctccaagccctcttggaaatgraagccgatgcagttttccataaaca

SEQ ID NO: 2844 - DNA, 50 bp, Artificial Sequence
  synthetic Elaeis guineensis (oil palm) single nucleotide polymorphism (SNP) in genomic region adjacent to shatterproof1 (SHELL) shell thickness gene
tggcctccaagccctcttggaaatrgaagccgatgcagttttccataaac

SEQ ID NO: 2845 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcactagctctagcggagcttgtgscctccaagccctcttggaaatggaa

SEQ ID NO: 2846 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcaacgtgcactagctctagcggascttgtggcctccaagccctcttgga

SEQ ID NO: 2847 - DNA, 50 bp, Artificial Sequence
  synthetic Elaeis guineensis (oil palm) single nucleotide polymorphism (SNP) in genomic region adjacent to shatterproof1 (SHELL) shell thickness gene
acatcttcttggtataatcatcaayaaagagaagaaaaaatcttttttga

SEQ ID NO: 2848 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttgaactggaagaagaaagagaatrcctctgacttttgctcaagaaagaa

SEQ ID NO: 2849 - DNA, 50 bp, Artificial Sequence
  synthetic Elaeis guineensis (oil palm) single nucleotide polymorphism (SNP) in genomic region adjacent to shatterproof1 (SHELL) shell thickness gene
gctctacaaaagctttgaactggargaagaaagagaatgcctctgacttt

SEQ ID NO: 2850 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttgatgattgctttgccgctctayaaaagctttgaactggaagaagaaa

SEQ ID NO: 2851 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtagttcatgaaggttccaaaggtraattctcctccacgatctattctta

SEQ ID NO: 2852 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcaactccattttattctggtgtgyagcggatagtgagttgtctctcgat

SEQ ID NO: 2853 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggcaagcctttgcattcatcatgcwtctagccatctctacaattgtgtaa

SEQ ID NO: 2854 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaaattatttggcaagcctttgcmttcatcatgcatctagccatctcta

SEQ ID NO: 2855 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgccaagcttcataaggagttttgytcagcattgcttttgttggagatct

SEQ ID NO: 2856 - DNA, 50 bp, Artificial Sequence
  synthetic Elaeis guineensis (oil palm) single nucleotide polymorphism (SNP) in genomic region adjacent to shatterproof1 (SHELL) shell thickness gene
atgccaagcttcataaggagttttrttcagcattgcttttgttggagatc

SEQ ID NO: 2857 - DNA, 50 bp, Artificial Sequence
  synthetic Elaeis guineensis (oil palm) single nucleotide polymorphism (SNP) in genomic region adjacent to shatterproof1 (SHELL) shell thickness gene
caaagactttaagatgatttacctsaggcttttgcctatgccaagcttca

SEQ ID NO: 2858 - DNA, 50 bp, Artificial Sequence
  synthetic Elaeis guineensis (oil palm) single nucleotide polymorphism (SNP) in genomic region adjacent to shatterproof1 (SHELL) shell thickness gene
agtcaaagactttaagatgatttayctcaggcttttgcctatgccaagct

SEQ ID NO: 2859 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgatcaaatttatctctattttgaratggaataagagaataagctatgca

SEQ ID NO: 2860 - DNA, 50 bp, Artificial Sequence
  synthetic Elaeis guineensis (oil palm) single nucleotide polymorphism (SNP) in genomic region adjacent to shatterproof1 (SHELL) shell thickness gene
tacaagttcatcaaagaatacatcwcgagaaacaataagttgattttttg

SEQ ID NO: 2861 - DNA, 50 bp, Artificial Sequence
  synthetic Elaeis guineensis (oil palm) single nucleotide polymorphism (SNP) in genomic region adjacent to shatterproof1 (SHELL) shell thickness gene
cccattattatgctacaagttcatyaaagaatacatctcgagaaacaata

SEQ ID NO: 2862 - DNA, 50 bp, Artificial Sequence
  synthetic Elaeis guineensis (oil palm) single nucleotide polymorphism (SNP) in genomic region adjacent to shatterproof1 (SHELL) shell thickness gene
gatgatttgacttgaaatgtcttcycttaatgctctcattgggcttggtt

SEQ ID NO: 2863 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgtaagctgcacaccttttttgggrtgaaatagaatctgtgatgatttga

SEQ ID NO: 2864 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtggttcacatgaaaagaaggcaayattacaagattcatagatctcatgt

SEQ ID NO: 2865 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcttcatctatgaattttagccaawtctcatcttttcttgcttttttaaa

SEQ ID NO: 2866 - DNA, 50 bp, Artificial Sequence
  synthetic Elaeis guineensis (oil palm) single nucleotide polymorphism (SNP) in genomic region adjacent to shatterproof1 (SHELL) shell thickness gene
agagatcaacaagctcccatgtgcmatttctttcgatagtgattatttct

SEQ ID NO: 2867 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctttgtgcttatcgattgagtcatyttttttgaactttgtcttatagatc

SEQ ID NO: 2868 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcaacagcaagaaccattctcactrtttctatacgaacaatagatgcaaa

SEQ ID NO: 2869 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcatttgaattgcaacagcaagaaycattctcactatttctatacgaaca

SEQ ID NO: 2870 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttgctttaggccatataatgccttycgaagccgatacatcttattttctt

SEQ ID NO: 2871 - DNA, 50 bp, Artificial Sequence
  synthetic Elaeis guineensis (oil palm) single nucleotide polymorphism (SNP) in genomic region adjacent to shatterproof1 (SHELL) shell thickness gene
tagtgaaaatagccatcaattctgrtgttccatgcatgcggagcttgctt

SEQ ID NO: 2872 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcaaatcatcaacatataagcaaargattaagaaatccttaccttgcaat

SEQ ID NO: 2873 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttcttccattatgatgtcggtgtakatcaaatcatcaacatataagcaaa

SEQ ID NO: 2874 - DNA, 50 bp, Artificial Sequence
  synthetic Elaeis guineensis (oil palm) single nucleotide polymorphism (SNP) in genomic region adjacent to shatterproof1 (SHELL) shell thickness gene
taacttggatgccaagaaaataatrcataagtccaagatcagtcatttca

SEQ ID NO: 2875 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttctattgtgatatgcaaatttttycattcgactgagtaacttggatgcc

SEQ ID NO: 2876 - DNA, 50 bp, Artificial Sequence
  synthetic Elaeis guineensis (oil palm) single nucleotide polymorphism (SNP) in genomic region adjacent to shatterproof1 (SHELL) shell thickness gene
caatttcccatatgaaacttcttgwgcaaatcttcaatatacttctattg

SEQ ID NO: 2877 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgaaatttcttatttttagccaaabgactggccatcggcttgcaatttcc

SEQ ID NO: 2878 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgtatgtgtgacataaatgagtgarccaactaaacttctataagttgtgg

SEQ ID NO: 2879 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttgcttggttgaatcataaatctrgataagagactaatcgaaaaaataa

SEQ ID NO: 2880 - DNA, 50 bp, Artificial Sequence
  synthetic Elaeis guineensis (oil palm) single nucleotide polymorphism (SNP) in genomic region adjacent to shatterproof1 (SHELL) shell thickness gene
gttcctaggcaaaatatgtagcctratgtacttttgcgatcatcaaaaga

SEQ ID NO: 2881 - DNA, 50 bp, Artificial Sequence
  synthetic Elaeis guineensis (oil palm) single nucleotide polymorphism (SNP) in genomic region adjacent to shatterproof1 (SHELL) shell thickness gene
acatcagtagctgaaatatattctrcttcagtagatgaaagtgccactac

SEQ ID NO: 2882 - DNA, 50 bp, Artificial Sequence
  synthetic Elaeis guineensis (oil palm) single nucleotide polymorphism (SNP) in genomic region adjacent to shatterproof1 (SHELL) shell thickness gene
gatatgcttggtcctgttatgaaayacaagattctttatcatagctattg

SEQ ID NO: 2883 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgacaaacactagttgaatatctcytttctcaacaagtctctgatgaaat

SEQ ID NO: 2884 - DNA, 50 bp, Artificial Sequence
  synthetic Elaeis guineensis (oil palm) single nucleotide polymorphism (SNP) in genomic region adjacent to shatterproof1 (SHELL) shell thickness gene
agatgacatttggaattcccaagtytcttgaatttcttaagactattaat

SEQ ID NO: 2885 - DNA, 50 bp, Artificial Sequence
  synthetic Elaeis guineensis (oil palm) single nucleotide polymorphism (SNP) in genomic region adjacent to shatterproof1 (SHELL) shell thickness gene
cagagttacaatatgactcttaatrttctagaacctgataaatgtgtctc

SEQ ID NO: 2886 - DNA, 50 bp, Artificial Sequence
  synthetic Elaeis guineensis (oil palm) single nucleotide polymorphism (SNP) in genomic region adjacent to shatterproof1 (SHELL) shell thickness gene
caactcatgcttcacatcataccargggctctattgcctcctatttatag

SEQ ID NO: 2887 - DNA, 50 bp, Artificial Sequence
  synthetic Elaeis guineensis (oil palm) single nucleotide polymorphism (SNP) in genomic region adjacent to shatterproof1 (SHELL) shell thickness gene
agggaagatatcataggaaaggccycaactcatgcttcacatcataccag

SEQ ID NO: 2888 - DNA, 50 bp, Artificial Sequence
  synthetic Elaeis guineensis (oil palm) single nucleotide polymorphism (SNP) in genomic region adjacent to shatterproof1 (SHELL) shell thickness gene
gagggaagatatcataggaaaggcyccaactcatgcttcacatcatacca

SEQ ID NO: 2889 - DNA, 50 bp, Artificial Sequence
  synthetic Elaeis guineensis (oil palm) single nucleotide polymorphism (SNP) in genomic region adjacent to shatterproof1 (SHELL) shell thickness gene
catcatcacatacttgttgggtgcyagaaagaatacaagagatttatgca

SEQ ID NO: 2890 - DNA, 50 bp, Artificial Sequence
  synthetic Elaeis guineensis (oil palm) single nucleotide polymorphism (SNP) in genomic region adjacent to shatterproof1 (SHELL) shell thickness gene
acaccaagcctcttatttatcaggrttgaattcctgcaagccatcaggct

SEQ ID NO: 2891 - DNA, 50 bp, Artificial Sequence
  synthetic Elaeis guineensis (oil palm) single nucleotide polymorphism (SNP) in genomic region adjacent to shatterproof1 (SHELL) shell thickness gene
atttaaaaaaaaaatcgatcatggwgtatggtagaatatttcaaagtctg

SEQ ID NO: 2892 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaataatatttaaaaaaaaaatcratcatggtgtatggtagaatatttc

SEQ ID NO: 2893 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctcagcccaagtattgtatttttgraaataagatgaaaagaggggtagat

SEQ ID NO: 2894 - DNA, 50 bp, Artificial Sequence
  synthetic Elaeis guineensis (oil palm) single nucleotide polymorphism (SNP) in genomic region adjacent to shatterproof1 (SHELL) shell thickness gene
tattcaaaatcgcatgttcaatatrtggtttcaccgtatccgtgcaaact

SEQ ID NO: 2895 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcaccccacctcaccacccccaccrtccagccaccgccccagccgcccag

SEQ ID NO: 2896 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcttcataccaaagggcaagcaggrgctgcaggtgtgggcttctccaaga

SEQ ID NO: 2897 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaatatcattattattagaaataraaatagaaggtataataatattatt

SEQ ID NO: 2898 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatttgattaataataaaatatcaytattattagaaatagaaatagaagg

SEQ ID NO: 2899 - DNA, 50 bp, Artificial Sequence
  synthetic Elaeis guineensis (oil palm) single nucleotide polymorphism (SNP) in genomic region adjacent to shatterproof1 (SHELL) shell thickness gene
agaagggaagggggtgctgggctayaggggcagtagagtgcagcacgggg

SEQ ID NO: 2900 - DNA, 50 bp, Artificial Sequence
  synthetic Elaeis guineensis (oil palm) single nucleotide polymorphism (SNP) in genomic region adjacent to shatterproof1 (SHELL) shell thickness gene
taccataacaaaaaatttaaaattwaaaatttattttaaatttaaaacta

SEQ ID NO: 2901 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttgatagggacacgacgaaaccacrtattgtggtttaatatgtgatttca

SEQ ID NO: 2902 - DNA, 50 bp, Artificial Sequence
  synthetic Elaeis guineensis (oil palm) single nucleotide polymorphism (SNP) in genomic region adjacent to shatterproof1 (SHELL) shell thickness gene
acttggagtgagttgatagggacaygacgaaaccacgtattgtggtttaa

SEQ ID NO: 2903 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtgctggtttacgagcacgtcaccwtcaaggctctaccgtgacagaactt

SEQ ID NO: 2904 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgaaaaatcaataattaagcaaaayttttatatgaagtccatttgatata

SEQ ID NO: 2905 - DNA, 50 bp, Artificial Sequence
  synthetic Elaeis guineensis (oil palm) single nucleotide polymorphism (SNP) in genomic region adjacent to shatterproof1 (SHELL) shell thickness gene
cttaaatcaaagaatagaatcactwgatgtcccttaaatgtctattattt

SEQ ID NO: 2906 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcctaatcattatttctccgttgcwagagatgcgtctcggtggcagatgg

SEQ ID NO: 2907 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatttatgaaagataatgacccttkttcttatttttctcttttttacata

SEQ ID NO: 2908 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagccttgctgatacaaaatttggrttcaatttatgaaagataatgaccc

SEQ ID NO: 2909 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgattaagtccggattgtaacatgkggacgacacatttgtgaagccttgc

SEQ ID NO: 2910 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttgaatcacaatttaataataactmccgctatgattaagtccggattgta

SEQ ID NO: 2911 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaggtaggttggcgattaattatakgctaaagagcagtaggtttcaaccc

SEQ ID NO: 2912 - DNA, 50 bp, Artificial Sequence
  synthetic Elaeis guineensis (oil palm) single nucleotide polymorphism (SNP) in genomic region adjacent to shatterproof1 (SHELL) shell thickness gene
acacagaaatacagacttctctctrgttcttactcatgctgcagaccatc

SEQ ID NO: 2913 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttcgtggcagaataacagaaaagtycagagataatagaagggtgaagaga

SEQ ID NO: 2914 - DNA, 50 bp, Artificial Sequence
  synthetic Elaeis guineensis (oil palm) single nucleotide polymorphism (SNP) in genomic region adjacent to shatterproof1 (SHELL) shell thickness gene
taaacatagtgaagctttgaaaatrtacttctgttactatgccttgcaat

SEQ ID NO: 2915 - DNA, 50 bp, Artificial Sequence
  synthetic Elaeis guineensis (oil palm) single nucleotide polymorphism (SNP) in genomic region adjacent to shatterproof1 (SHELL) shell thickness gene
cttgtagtgcatgccaagtctcaawaaacatagtgaagctttgaaaatat

SEQ ID NO: 2916 - DNA, 50 bp, Artificial Sequence
  synthetic Elaeis guineensis (oil palm) single nucleotide polymorphism (SNP) in genomic region adjacent to shatterproof1 (SHELL) shell thickness gene
gataggataaatacattgtgaactygatctatttcacctatgaaagagca

SEQ ID NO: 2917 - DNA, 50 bp, Artificial Sequence
  synthetic Elaeis guineensis (oil palm) single nucleotide polymorphism (SNP) in genomic region adjacent to shatterproof1 (SHELL) shell thickness gene
atgtgcaaaaccttagaattaccgsataggataaatacattgtgaacttg

SEQ ID NO: 2918 - DNA, 50 bp, Artificial Sequence
  synthetic Elaeis guineensis (oil palm) single nucleotide polymorphism (SNP) in genomic region adjacent to shatterproof1 (SHELL) shell thickness gene
atttgatgtgcaaaaccttagaatwaccggataggataaatacattgtga

SEQ ID NO: 2919 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcgaaattaagattcagtagcacgrtatggttatttgatgtgcaaaacct

SEQ ID NO: 2920 - DNA, 50 bp, Artificial Sequence
  synthetic Elaeis guineensis (oil palm) single nucleotide polymorphism (SNP) in genomic region adjacent to shatterproof1 (SHELL) shell thickness gene
caagttgtttatgatcatttgagtyataaaattatcgaaattaagattca

SEQ ID NO: 2921 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgtctctggttttgttgtgccaccragttgtttatgatcatttgagttat

SEQ ID NO: 2922 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaatcattttgtagtcatgctgayggcactgtctctggttttgttgtgc

SEQ ID NO: 2923 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagcaatccatgtaatggaattgarctgcaagacatcaagctcacctatg

SEQ ID NO: 2924 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtcttgagtatttgtttcaaggccwgacgtcataaaacagtgatggtgct

SEQ ID NO: 2925 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtcctggccatggcatcaggtaatyaagggaacatgcatgtattgcatta

SEQ ID NO: 2926 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgtacattacgagtccaccaatttraaaaaagaccatataataaattaat

SEQ ID NO: 2927 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttacgggaaaagtacgtggaagtaytgttgaatgaaggaatccagaaatt

SEQ ID NO: 2928 - DNA, 50 bp, Artificial Sequence
  synthetic Elaeis guineensis (oil palm) single nucleotide polymorphism (SNP) in genomic region adjacent to shatterproof1 (SHELL) shell thickness gene
aggtctttttttttttcctctttamgggaaaagtacgtggaagtactgtt

SEQ ID NO: 2929 - DNA, 50 bp, Artificial Sequence
  synthetic Elaeis guineensis (oil palm) single nucleotide polymorphism (SNP) in genomic region adjacent to shatterproof1 (SHELL) shell thickness gene
gatttcaaaaagagtgtctactgcrcattaatccatttggtgaggcacca

SEQ ID NO: 2930 - DNA, 50 bp, Artificial Sequence
  synthetic Elaeis guineensis (oil palm) single nucleotide polymorphism (SNP) in genomic region adjacent to shatterproof1 (SHELL) shell thickness gene
gattataataaaagtgaacatcagrccgttcattaacgcctcactaatca

SEQ ID NO: 2931 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttgtcttcagttctttctttttccsttgttggggtgtaggccccccaaat

SEQ ID NO: 2932 - DNA, 50 bp, Artificial Sequence
  synthetic Elaeis guineensis (oil palm) single nucleotide polymorphism (SNP) in genomic region adjacent to shatterproof1 (SHELL) shell thickness gene
acaagacaatattttcaaaagttcwtatgataagtctgcagaggaaaacc

SEQ ID NO: 2933 - DNA, 50 bp, Artificial Sequence
  synthetic Elaeis guineensis (oil palm) single nucleotide polymorphism (SNP) in genomic region adjacent to shatterproof1 (SHELL) shell thickness gene
atgggggcagtaattttggtcaatratgatgggatttcggacattctgca

SEQ ID NO: 2934 - DNA, 50 bp, Artificial Sequence
  synthetic Elaeis guineensis (oil palm) single nucleotide polymorphism (SNP) in genomic region adjacent to shatterproof1 (SHELL) shell thickness gene
tggcttgtttccgtaggtaagcttkatgtcttgcagtccaattccggtgc

SEQ ID NO: 2935 - DNA, 50 bp, Artificial Sequence
  synthetic Elaeis guineensis (oil palm) single nucleotide polymorphism (SNP) in genomic region adjacent to shatterproof1 (SHELL) shell thickness gene
caactcgaagagtcagaagcaactyggcacaacagaaccagaggcagtac

SEQ ID NO: 2936 - DNA, 50 bp, Artificial Sequence
  synthetic Elaeis guineensis (oil palm) single nucleotide polymorphism (SNP) in genomic region adjacent to shatterproof1 (SHELL) shell thickness gene
cattccatgtctactagagtaacgsttggacatggaggataagaaaagtt

SEQ ID NO: 2937 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatcaatccattaaatatttattcyattccatgtctactagagtaacgct

SEQ ID NO: 2938 - DNA, 50 bp, Artificial Sequence
  synthetic Elaeis guineensis (oil palm) single nucleotide polymorphism (SNP) in genomic region adjacent to shatterproof1 (SHELL) shell thickness gene
agacgattgcattcctaattagagrgattcaatttaaaaattatacaaac

SEQ ID NO: 2939 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttctctaattagacgattgcattcytaattagagagattcaatttaaaaa

SEQ ID NO: 2940 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctaattagacgattgcattcctaakcagagggattcaatttagaaattat

SEQ ID NO: 2941 - DNA, 50 bp, Artificial Sequence
  synthetic Elaeis guineensis (oil palm) single nucleotide polymorphism (SNP) in genomic region adjacent to shatterproof1 (SHELL) shell thickness gene
tggatgttttcgtgggtatttataygtacacttacggattatatgtatgt

SEQ ID NO: 2942 - DNA, 50 bp, Artificial Sequence
  synthetic Elaeis guineensis (oil palm) single nucleotide polymorphism (SNP) in genomic region adjacent to shatterproof1 (SHELL) shell thickness gene
caccaggatggtcgcaggtcccggsgagccgcaggcggcgtcccatgcac

SEQ ID NO: 2943 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgccccggccatcgatggtcccgcyggacacagagagaccctggactcca

SEQ ID NO: 2944 - DNA, 50 bp, Artificial Sequence
  synthetic Elaeis guineensis (oil palm) single nucleotide polymorphism (SNP) in genomic region adjacent to shatterproof1 (SHELL) shell thickness gene
caataggaaagaaataaggatcaamtgaaggaccgcccgaggaaacgtac

SEQ ID NO: 2945 - DNA, 50 bp, Artificial Sequence
  synthetic Elaeis guineensis (oil palm) single nucleotide polymorphism (SNP) in genomic region adjacent to shatterproof1 (SHELL) shell thickness gene
taagacggagaataaattacaatargaaagaaataaggatcaaatgaagg

SEQ ID NO: 2946 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaattacgttatcatatgagttaasacggagaataaattacaataggaaa

SEQ ID NO: 2947 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaataaaatactgaagctacagcartcatacctcctcgtcttcaggaacg

SEQ ID NO: 2948 - DNA, 50 bp, Artificial Sequence
  synthetic Elaeis guineensis (oil palm) single nucleotide polymorphism (SNP) in genomic region adjacent to shatterproof1 (SHELL) shell thickness gene
agccattattttttcttccttgaakgtacgttagccattaattatatgct

SEQ ID NO: 2949 - DNA, 50 bp, Artificial Sequence
  synthetic Elaeis guineensis (oil palm) single nucleotide polymorphism (SNP) in genomic region adjacent to shatterproof1 (SHELL) shell thickness gene
cagataatatcatacttaccatagyttgtgctagggacatgaggttagcc

SEQ ID NO: 2950 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgtatagaagtatggagcttccgtyagcacggttctcgaaaaagaaaaaa

SEQ ID NO: 2951 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtatcaaaaaaaaaatataatgaartttagaaaatgtacttttgttacta

SEQ ID NO: 2952 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctcaatcacttgtacagtacttgyagtgcatgccaagtctcaataaaca

SEQ ID NO: 2953 - DNA, 50 bp, Artificial Sequence
  synthetic Elaeis guineensis (oil palm) single nucleotide polymorphism (SNP) in genomic region adjacent to shatterproof1 (SHELL) shell thickness gene
gatcacttgagtcataaaattatcraaattaagactcagtggcacagtat

SEQ ID NO: 2954 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgcagtgaaagcaatccatgcagtraaattgagctgcaagacatcaagct

SEQ ID NO: 2955 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttcttttgttttcgatagaattcrtctgcatcacaagtggtcatgaact

SEQ ID NO: 2956 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaattgaaaaatttttttgctatgwatttttgagctttcattttcttttg

SEQ ID NO: 2957 - DNA, 50 bp, Artificial Sequence
  synthetic Elaeis guineensis (oil palm) single nucleotide polymorphism (SNP) in genomic region adjacent to shatterproof1 (SHELL) shell thickness gene
gatacaatccaagcccatgcgagtsagtggcaacctatgtcatcttttgg

SEQ ID NO: 2958 - DNA, 50 bp, Artificial Sequence
  synthetic Elaeis guineensis (oil palm) single nucleotide polymorphism (SNP) in genomic region adjacent to shatterproof1 (SHELL) shell thickness gene
actttctttatgcatgaagccatcrttggattgcacaatggtcgcttcaa

SEQ ID NO: 2959 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcagtccccaccagatttggtcatrtagcattactttctttatgcatgaa

SEQ ID NO: 2960 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatgcatacttgtacgaggaattcytgcgtcaaaaattctttgggaccaa

SEQ ID NO: 2961 - DNA, 50 bp, Artificial Sequence
  synthetic Elaeis guineensis (oil palm) single nucleotide polymorphism (SNP) in genomic region adjacent to shatterproof1 (SHELL) shell thickness gene
aacggagaaaagatcactatgcatrcttgtacgaggaattcctgcgtcaa

SEQ ID NO: 2962 - DNA, 50 bp, Artificial Sequence
  synthetic Elaeis guineensis (oil palm) single nucleotide polymorphism (SNP) in genomic region adjacent to shatterproof1 (SHELL) shell thickness gene
caccatccttcgtcttccactattmatgtgcgagaataacgtgaataaaa

SEQ ID NO: 2963 - DNA, 50 bp, Artificial Sequence
  synthetic Elaeis guineensis (oil palm) single nucleotide polymorphism (SNP) in genomic region adjacent to shatterproof1 (SHELL) shell thickness gene
atgaaattaagttcatttgcagggrgaaatgcgtcatattggggtggggc

SEQ ID NO: 2964 - DNA, 50 bp, Artificial Sequence
  synthetic Elaeis guineensis (oil palm) single nucleotide polymorphism (SNP) in genomic region adjacent to shatterproof1 (SHELL) shell thickness gene
cctgcggtcctggccatggcatcawgtaagggaacatgtatgtgttgcat

SEQ ID NO: 2965 - DNA, 50 bp, Artificial Sequence
  synthetic Elaeis guineensis (oil palm) single nucleotide polymorphism (SNP) in genomic region adjacent to shatterproof1 (SHELL) shell thickness gene
cacattgtgatcgatgactgtcagrgagtgatggtacaaggtgtcaagac

SEQ ID NO: 2966 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgcagtcgttagccttccatggctygaagaacatcatgataagtgggctg

SEQ ID NO: 2967 - DNA, 50 bp, Artificial Sequence
  synthetic Elaeis guineensis (oil palm) single nucleotide polymorphism (SNP) in genomic region adjacent to shatterproof1 (SHELL) shell thickness gene
taacttaattatgcgataactttawttcatcatttcttcatgcagtcgtt

SEQ ID NO: 2968 - DNA, 50 bp, Artificial Sequence
  synthetic Elaeis guineensis (oil palm) single nucleotide polymorphism (SNP) in genomic region adjacent to shatterproof1 (SHELL) shell thickness gene
caattgttttcgtcagaggatgatsaggttgaatcgcattttaggatggt

SEQ ID NO: 2969 - DNA, 50 bp, Artificial Sequence
  synthetic Elaeis guineensis (oil palm) single nucleotide polymorphism (SNP) in genomic region adjacent to shatterproof1 (SHELL) shell thickness gene
atttgcctctccaacaattgttttygtcagaggatgatcaggttgaatcg

SEQ ID NO: 2970 - DNA, 50 bp, Artificial Sequence
  synthetic Elaeis guineensis (oil palm) single nucleotide polymorphism (SNP) in genomic region adjacent to shatterproof1 (SHELL) shell thickness gene
acgacacctctttgataattcggayagtatctatagactctgcatctagc

SEQ ID NO: 2971 - DNA, 50 bp, Artificial Sequence
  synthetic Elaeis guineensis (oil palm) single nucleotide polymorphism (SNP) in genomic region adjacent to shatterproof1 (SHELL) shell thickness gene
atatatatatatttctaaattttarttatttaaaaattaatttttttatt

SEQ ID NO: 2972 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagtccttaaatttctcaatagcarcagcaatatgatcatattttggagt

SEQ ID NO: 2973 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaagcttgacaagctgaaaatgctwcagccacatactctatttcagaaga

SEQ ID NO: 2974 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctcggggatgcttgcttcttctcscagccacaaaaacctcccaagatat

SEQ ID NO: 2975 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggtggtatcctggccagacatccayccaacacccgtgccttcagaactct

SEQ ID NO: 2976 - DNA, 50 bp, Artificial Sequence
  synthetic Elaeis guineensis (oil palm) single nucleotide polymorphism (SNP) in genomic region adjacent to shatterproof1 (SHELL) shell thickness gene
aggatcttgggaggtggtatcctgrccagacatccatccaacacccgtgc

SEQ ID NO: 2977 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttttctttcttcctgctgcatcgcrtggtactgaaaggatcttgggaggt

SEQ ID NO: 2978 - DNA, 50 bp, Artificial Sequence
  synthetic Elaeis guineensis (oil palm) single nucleotide polymorphism (SNP) in genomic region adjacent to shatterproof1 (SHELL) shell thickness gene
cccgtggaggcgagctcttttgtgrctgatccacgtattttgattgtttt

SEQ ID NO: 2979 - DNA, 50 bp, Artificial Sequence
  synthetic Elaeis guineensis (oil palm) single nucleotide polymorphism (SNP) in genomic region adjacent to shatterproof1 (SHELL) shell thickness gene
acttcaggtgagagagaattgggtrtacaagggttgagggtgaggtctcc

SEQ ID NO: 2980 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagagagagagagcttttgtgaggrgaacttcaggtgagagagaattggg

SEQ ID NO: 2981 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaggagcaggaggctccttgacagyggtcgccaggctcttcaggggttca

SEQ ID NO: 2982 - DNA, 50 bp, Artificial Sequence
  synthetic Elaeis guineensis (oil palm) single nucleotide polymorphism (SNP) in genomic region adjacent to shatterproof1 (SHELL) shell thickness gene
atctgagagcgtgggtggctcccgrtcttgatccgacggtccaggggcta

SEQ ID NO: 2983 - DNA, 50 bp, Artificial Sequence
  synthetic Elaeis guineensis (oil palm) single nucleotide polymorphism (SNP) in genomic region adjacent to shatterproof1 (SHELL) shell thickness gene
acccggctcaagtttgctttggttractagaataaaagtgaacatcaggt

SEQ ID NO: 2984 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccccctccttttcgtctcttttccycctctccttttccccaaatgagaaa

SEQ ID NO: 2985 - DNA, 50 bp, Artificial Sequence
  synthetic Elaeis guineensis (oil palm) single nucleotide polymorphism (SNP) in genomic region adjacent to shatterproof1 (SHELL) shell thickness gene
aactaggggttttctcttttccccyctccttttcgtctcttttcctcctc

SEQ ID NO: 2986 - DNA, 50 bp, Artificial Sequence
  synthetic Elaeis guineensis (oil palm) single nucleotide polymorphism (SNP) in genomic region adjacent to shatterproof1 (SHELL) shell thickness gene
cgaatgcaagtttctatgataaggmtatattttcaaaagtttgtatgata

SEQ ID NO: 2987 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtgagggtaaatgggtcatttcatrgtgttaccacctaccgttgcgccgg

SEQ ID NO: 2988 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttactatgtacgtagaacagcagtsagtggcaacaataaaaaagctgtga

SEQ ID NO: 2989 - DNA, 50 bp, Artificial Sequence
  synthetic Elaeis guineensis (oil palm) single nucleotide polymorphism (SNP) in genomic region adjacent to shatterproof1 (SHELL) shell thickness gene
acgactgcatggagaggagcacaayataacatatggtcagctcaatttac

SEQ ID NO: 2990 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcgagttcctgaacactaacgactkcatggagaggagcacaatataacat

SEQ ID NO: 2991 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccgtcaccgcctggcagccatcgawcacgatgtggaacctctcgctattg

SEQ ID NO: 2992 - DNA, 50 bp, Artificial Sequence
  synthetic Elaeis guineensis (oil palm) single nucleotide polymorphism (SNP) in genomic region adjacent to shatterproof1 (SHELL) shell thickness gene
atggccaggtccgcaagtgaccttytcgatccataggttcgtcgtgccag

SEQ ID NO: 2993 - DNA, 50 bp, Artificial Sequence
  synthetic Elaeis guineensis (oil palm) single nucleotide polymorphism (SNP) in genomic region adjacent to shatterproof1 (SHELL) shell thickness gene
catcacacgtgtgagtgttccaacrtaagcatcttatacgcgtgaaactc

SEQ ID NO: 2994 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccgttatgttcatgagaataccgarcatgatagaatacgttattctatac

SEQ ID NO: 2995 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttaaggccgaaattattatcaataraaaagacatatcgatccattaaata

SEQ ID NO: 2996 - DNA, 50 bp, Artificial Sequence
  synthetic Elaeis guineensis (oil palm) single nucleotide polymorphism (SNP) in genomic region adjacent to shatterproof1 (SHELL) shell thickness gene
cacccttgaggactttttgggcacyggacgaatattgcgtcgttaattgg

SEQ ID NO: 2997 - DNA, 50 bp, Artificial Sequence
  synthetic Elaeis guineensis (oil palm) single nucleotide polymorphism (SNP) in genomic region adjacent to shatterproof1 (SHELL) shell thickness gene
gggcttgtttttgagtgtaggccaraattttgaactaagttttcgtctct

SEQ ID NO: 2998 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaataaaaaaatataaaaataatayttagtacttcacataacattaaaat

SEQ ID NO: 2999 - DNA, 50 bp, Artificial Sequence
  synthetic Elaeis guineensis (oil palm) single nucleotide polymorphism (SNP) in genomic region adjacent to shatterproof1 (SHELL) shell thickness gene
tccttgatgtaatgatgatccactrgtctctcttttttatatttagggat

SEQ ID NO: 3000 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttaatccaaaataaattgattaacktactttaacctaattgattttaaac

SEQ ID NO: 3001 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccaccctccttgccacattctatakatgcccattttctacatataaaata

SEQ ID NO: 3002 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtccgagttgggagaggcggtgcargctttgtcatccgtggtccggatga

SEQ ID NO: 3003 - DNA, 50 bp, Artificial Sequence
  synthetic Elaeis guineensis (oil palm) single nucleotide polymorphism (SNP) in genomic region adjacent to shatterproof1 (SHELL) shell thickness gene
agaacccctaccttaggggtttgtyaagataaaatttgatggtagtgtcc

SEQ ID NO: 3004 - DNA, 50 bp, Artificial Sequence
  synthetic Elaeis guineensis (oil palm) single nucleotide polymorphism (SNP) in genomic region adjacent to shatterproof1 (SHELL) shell thickness gene
tagggttctatccatttcttgagarcccctaccttaggggtttgttaaga

SEQ ID NO: 3005 - DNA, 50 bp, Artificial Sequence
  synthetic Elaeis guineensis (oil palm) single nucleotide polymorphism (SNP) in genomic region adjacent to shatterproof1 (SHELL) shell thickness gene
tccttggcttgatccatcagagtayggttgattggatggctatggatggt

SEQ ID NO: 3006 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcgttcggtgggggtgatttaggawgcctgagttttgagcattcctttat

SEQ ID NO: 3007 - DNA, 50 bp, Artificial Sequence
  synthetic Elaeis guineensis (oil palm) single nucleotide polymorphism (SNP) in genomic region adjacent to shatterproof1 (SHELL) shell thickness gene
gggatctattccttattgacgaagmgggaggctctgcttgccagacatgt

SEQ ID NO: 3008 - DNA, 50 bp, Artificial Sequence
  synthetic Elaeis guineensis (oil palm) single nucleotide polymorphism (SNP) in genomic region adjacent to shatterproof1 (SHELL) shell thickness gene
aattttaaaaaataaaaaattagtmtttatttataataaaatttttcatc

SEQ ID NO: 3009 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttattgccaatagttaaaaaaatyaaaattttaaaaaataaaaaattag

SEQ ID NO: 3010 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttcgtcgtcaataatattattggygatgaaaaataaaattgatcataaa

SEQ ID NO: 3011 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctttcacttcttcagggatcgatrgatgaggtcgctagatgaggactgt

SEQ ID NO: 3012 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggagggatccgaaaggagatctttyacttcttcagggatcgatagatgag

SEQ ID NO: 3013 - DNA, 50 bp, Artificial Sequence
  synthetic Elaeis guineensis (oil palm) single nucleotide polymorphism (SNP) in genomic region adjacent to shatterproof1 (SHELL) shell thickness gene
agctacggaggagtgacggtggtaytgtggctgatagtggagggatccga

SEQ ID NO: 3014 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggcttacttgagcatgagttggggragctacgaggtaagctctttgagca

SEQ ID NO: 3015 - DNA, 50 bp, Artificial Sequence
  synthetic Elaeis guineensis (oil palm) single nucleotide polymorphism (SNP) in genomic region adjacent to shatterproof1 (SHELL) shell thickness gene
agtgacatcttccaacagattgagygggttgaggctgatattgaggagct

SEQ ID NO: 3016 - DNA, 50 bp, Artificial Sequence
  synthetic Elaeis guineensis (oil palm) single nucleotide polymorphism (SNP) in genomic region adjacent to shatterproof1 (SHELL) shell thickness gene
actttttgtctttgagagccttgayggagtttgtctccattgtccacttc

SEQ ID NO: 3017 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgaccttgaccgtccattacgatcraggaccgctggggttcacccgtgca

SEQ ID NO: 3018 - DNA, 50 bp, Artificial Sequence
  synthetic Elaeis guineensis (oil palm) single nucleotide polymorphism (SNP) in genomic region adjacent to shatterproof1 (SHELL) shell thickness gene
atccaacttgaccttgaccgtccaytacgatcgaggaccgctggggttca

SEQ ID NO: 3019 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcgagctggggtttcatggtgaggragatgcgtgatcgtttgaaagatga

SEQ ID NO: 3020 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagatcgtatccctgcatcggtggytggaatttgcacttaggagtgcttt

SEQ ID NO: 3021 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggacatgcatgctttcaatcttctrgtttgtattttttttgagtcaactc

SEQ ID NO: 3022 - DNA, 50 bp, Artificial Sequence
  synthetic Elaeis guineensis (oil palm) single nucleotide polymorphism (SNP) in genomic region adjacent to shatterproof1 (SHELL) shell thickness gene
aggaatagtttgcaaatgatacaayggacatgcatgctttcaatcttcta

SEQ ID NO: 3023 - DNA, 50 bp, Artificial Sequence
  synthetic Elaeis guineensis (oil palm) single nucleotide polymorphism (SNP) in genomic region adjacent to shatterproof1 (SHELL) shell thickness gene
acctaaatcacatttttgaaatagraatagtttgcaaatgatacaacgga

SEQ ID NO: 3024 - DNA, 50 bp, Artificial Sequence
  synthetic Elaeis guineensis (oil palm) single nucleotide polymorphism (SNP) in genomic region adjacent to shatterproof1 (SHELL) shell thickness gene
gacgttttgagattcttgtcaaaaktgggacaattatttcatttttggta

SEQ ID NO: 3025 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatatattaaattattactgtacgrgtgcttagcaatattttagctctgg

SEQ ID NO: 3026 - DNA, 50 bp, Artificial Sequence
  synthetic Elaeis guineensis (oil palm) single nucleotide polymorphism (SNP) in genomic region adjacent to shatterproof1 (SHELL) shell thickness gene
atatatacatatatattaaattatyactgtacgggtgcttagcaatattt

SEQ ID NO: 3027 - DNA, 50 bp, Artificial Sequence
  synthetic Elaeis guineensis (oil palm) single nucleotide polymorphism (SNP) in genomic region adjacent to shatterproof1 (SHELL) shell thickness gene
atgagttttaatttaattctttaayatcataatatttttttatttaatta

SEQ ID NO: 3028 - DNA, 50 bp, Artificial Sequence
  synthetic Elaeis guineensis (oil palm) single nucleotide polymorphism (SNP) in genomic region adjacent to shatterproof1 (SHELL) shell thickness gene
atattgatatttgcatctattattrtatatttagatataaatttttaatt

SEQ ID NO: 3029 - DNA, 50 bp, Artificial Sequence
  synthetic Elaeis guineensis (oil palm) single nucleotide polymorphism (SNP) in genomic region adjacent to shatterproof1 (SHELL) shell thickness gene
gagttagactataatttaaatctarttaaggaaactgatcgttggctgta

SEQ ID NO: 3030 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaaataaaaattatacatattcayctctgcatgagttttttttttgaat

SEQ ID NO: 3031 - DNA, 50 bp, Artificial Sequence
  synthetic Elaeis guineensis (oil palm) single nucleotide polymorphism (SNP) in genomic region adjacent to shatterproof1 (SHELL) shell thickness gene
gattaattaatattatataattttwaaaaataaaaattatacatattcac

SEQ ID NO: 3032 - DNA, 50 bp, Artificial Sequence
  synthetic Elaeis guineensis (oil palm) single nucleotide polymorphism (SNP) in genomic region adjacent to shatterproof1 (SHELL) shell thickness gene
catcaaaacctcctccgcctctctyctccttcctcatccccacaaccatc

SEQ ID NO: 3033 - DNA, 50 bp, Artificial Sequence
  synthetic Elaeis guineensis (oil palm) single nucleotide polymorphism (SNP) in genomic region adjacent to shatterproof1 (SHELL) shell thickness gene
agttttcccctacccaatctcatgrcatggatgaggataaggccgtgaga

SEQ ID NO: 3034 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcgaccaaaatagaggaagttttcycctacccaatctcatggcatggatg

SEQ ID NO: 3035 - DNA, 50 bp, Artificial Sequence
  synthetic Elaeis guineensis (oil palm) single nucleotide polymorphism (SNP) in genomic region adjacent to shatterproof1 (SHELL) shell thickness gene
agaatcggtctcattggacctggtwaagcatgaagccagcaaagattgcc

SEQ ID NO: 3036 - DNA, 50 bp, Artificial Sequence
  synthetic Elaeis guineensis (oil palm) single nucleotide polymorphism (SNP) in genomic region adjacent to shatterproof1 (SHELL) shell thickness gene
agggggtgaaattccagaattgacrtagagatgtcaaattatgaagtatt

SEQ ID NO: 3037 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcataattatgatggatcaatattrttgcctaaagccattactacctaat

SEQ ID NO: 3038 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctatatctatttggttagatggtcmaagatattatgttttatcataaaaa

SEQ ID NO: 3039 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttatgatttctatatctatttggwtagatggtcaaagatattatgtttt

SEQ ID NO: 3040 - DNA, 50 bp, Artificial Sequence
  synthetic Elaeis guineensis (oil palm) single nucleotide polymorphism (SNP) in genomic region adjacent to shatterproof1 (SHELL) shell thickness gene
atttggattttgacatccataaggwaaatgactaaactctttacaatgta

SEQ ID NO: 3041 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagcaatcgtgtaaccagattaaaktatttggattttgacatccataagg

SEQ ID NO: 3042 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcactggacagctcatcatgttcgyatattgtagaagtccaattcggggg

SEQ ID NO: 3043 - DNA, 50 bp, Artificial Sequence
  synthetic Elaeis guineensis (oil palm) single nucleotide polymorphism (SNP) in genomic region adjacent to shatterproof1 (SHELL) shell thickness gene
cggcgtcccatgcatcaaggaatgmtttggtcgaatccgtctcgccatct

SEQ ID NO: 3044 - DNA, 50 bp, Artificial Sequence
  synthetic Elaeis guineensis (oil palm) single nucleotide polymorphism (SNP) in genomic region adjacent to shatterproof1 (SHELL) shell thickness gene
ataatcggttggtgcaacaagggtrccgtcgatctggacggtgatgtagc

SEQ ID NO: 3045 - DNA, 50 bp, Artificial Sequence
  synthetic Elaeis guineensis (oil palm) single nucleotide polymorphism (SNP) in genomic region adjacent to shatterproof1 (SHELL) shell thickness gene
tacaataagaaagaaatatggatcraatgaaggaccgcccgaggaaacgt

SEQ ID NO: 3046 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaatgacgaattacgttatcatatkagttaagacggagaataaattacaa

SEQ ID NO: 3047 - DNA, 50 bp, Artificial Sequence
  synthetic Elaeis guineensis (oil palm) single nucleotide polymorphism (SNP) in genomic region adjacent to shatterproof1 (SHELL) shell thickness gene
accatgtggtacagctcgctgttcytcgacctcaacccactgatcgttac

SEQ ID NO: 3048 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttaaaaattccagctcagaaaagcygtaacttatatatatatacatattg

SEQ ID NO: 3049 - DNA, 50 bp, Artificial Sequence
  synthetic Elaeis guineensis (oil palm) single nucleotide polymorphism (SNP) in genomic region adjacent to shatterproof1 (SHELL) shell thickness gene
gttggcataataagaacaacaaaastgaaaattttatttcgatatatttt

SEQ ID NO: 3050 - DNA, 50 bp, Artificial Sequence
  synthetic Elaeis guineensis (oil palm) single nucleotide polymorphism (SNP) in genomic region adjacent to shatterproof1 (SHELL) shell thickness gene
acttgggtgggttagattggatcgygggcaaaccccatgccaactcaacc

SEQ ID NO: 3051 - DNA, 50 bp, Artificial Sequence
  synthetic Elaeis guineensis (oil palm) single nucleotide polymorphism (SNP) in genomic region adjacent to shatterproof1 (SHELL) shell thickness gene
gccatgcctaagtacccaaggcctwcctaagcacttttaacaaaaacttt

SEQ ID NO: 3052 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatacctctcattgttctaaatttyaatatattttatgatttagggattg

SEQ ID NO: 3053 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctttttcttttattgactagaatmgggaaagcctagctgaaaactaagg

SEQ ID NO: 3054 - DNA, 50 bp, Artificial Sequence
  synthetic Elaeis guineensis (oil palm) single nucleotide polymorphism (SNP) in genomic region adjacent to shatterproof1 (SHELL) shell thickness gene
atctttattttctttttcttttatygactagaatagggaaagcctagctg

SEQ ID NO: 3055 - DNA, 50 bp, Artificial Sequence
  synthetic Elaeis guineensis (oil palm) single nucleotide polymorphism (SNP) in genomic region adjacent to shatterproof1 (SHELL) shell thickness gene
tggattcaatcctacccggtgtggyttcaagtcaaagattagcttcaatc

SEQ ID NO: 3056 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggctaacatgatattttactacttyaagttaagaaaatcagaatttgacc

SEQ ID NO: 3057 - DNA, 50 bp, Artificial Sequence
  synthetic Elaeis guineensis (oil palm) single nucleotide polymorphism (SNP) in genomic region adjacent to shatterproof1 (SHELL) shell thickness gene
actgcacctgccccatgttctcctrgtgagttggtcaaaaggatgttgca

SEQ ID NO: 3058 - DNA, 50 bp, Artificial Sequence
  synthetic Elaeis guineensis (oil palm) single nucleotide polymorphism (SNP) in genomic region adjacent to shatterproof1 (SHELL) shell thickness gene
gattgcatgctggtgaaaagcttckaccataaaatgtccacagctatgaa

SEQ ID NO: 3059 - DNA, 50 bp, Artificial Sequence
  synthetic Elaeis guineensis (oil palm) single nucleotide polymorphism (SNP) in genomic region adjacent to shatterproof1 (SHELL) shell thickness gene
cccatggagaaatgattgcatgctrgtgaaaagcttctaccataaaatgt

SEQ ID NO: 3060 - DNA, 50 bp, Artificial Sequence
  synthetic Elaeis guineensis (oil palm) single nucleotide polymorphism (SNP) in genomic region adjacent to shatterproof1 (SHELL) shell thickness gene
gttgtctatttcttctaattgtcamccgagatgatggagtagctgcagaa

SEQ ID NO: 3061 - DNA, 50 bp, Artificial Sequence
  synthetic Elaeis guineensis (oil palm) single nucleotide polymorphism (SNP) in genomic region adjacent to shatterproof1 (SHELL) shell thickness gene
taaagacgcaccgaaatttgtatawtttggtggagtcacagcgttattgg

SEQ ID NO: 3062 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaacataaggcaatgacttatttsgcatttaggtcaatttgtctacatg

SEQ ID NO: 3063 - DNA, 50 bp, Artificial Sequence
  synthetic Elaeis guineensis (oil palm) single nucleotide polymorphism (SNP) in genomic region adjacent to shatterproof1 (SHELL) shell thickness gene
tagaaatgaaagtgttctgtgcttmatttggttcatgaaaaacataaggc

SEQ ID NO: 3064 - DNA, 50 bp, Artificial Sequence
  synthetic Elaeis guineensis (oil palm) single nucleotide polymorphism (SNP) in genomic region adjacent to shatterproof1 (SHELL) shell thickness gene
acctgaatacagtgtatagtgcacwactagtcaagactattcaacatgac

SEQ ID NO: 3065 - DNA, 50 bp, Artificial Sequence
  synthetic Elaeis guineensis (oil palm) single nucleotide polymorphism (SNP) in genomic region adjacent to shatterproof1 (SHELL) shell thickness gene
catggaaaacacctgaatacagtgyatagtgcacaactagtcaagactat

SEQ ID NO: 3066 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgtccctcgaatatttttgtagttsacatggctgatctcaatgcccgaat

SEQ ID NO: 3067 - DNA, 50 bp, Artificial Sequence
  synthetic Elaeis guineensis (oil palm) single nucleotide polymorphism (SNP) in genomic region adjacent to shatterproof1 (SHELL) shell thickness gene
atgtttgcaagaagaccatgcccgycgattttgataggtgagcttaatat

SEQ ID NO: 3068 - DNA, 50 bp, Artificial Sequence
  synthetic Elaeis guineensis (oil palm) single nucleotide polymorphism (SNP) in genomic region adjacent to shatterproof1 (SHELL) shell thickness gene
agggcattcgagtgtcggcttgagyaggccaatgcacatactacccaata

SEQ ID NO: 3069 - DNA, 50 bp, Artificial Sequence
  synthetic Elaeis guineensis (oil palm) single nucleotide polymorphism (SNP) in genomic region adjacent to shatterproof1 (SHELL) shell thickness gene
gagtcatttagaataatcaaaagamaaagaaaagaaaggttcaaggtgat

SEQ ID NO: 3070 - DNA, 50 bp, Artificial Sequence
  synthetic Elaeis guineensis (oil palm) single nucleotide polymorphism (SNP) in genomic region adjacent to shatterproof1 (SHELL) shell thickness gene
caaagaaaatgtttctcgtccaaaracaaaagtcaaaaaacaaagatgtt

SEQ ID NO: 3071 - DNA, 50 bp, Artificial Sequence
  synthetic Elaeis guineensis (oil palm) single nucleotide polymorphism (SNP) in genomic region adjacent to shatterproof1 (SHELL) shell thickness gene
gatagatctcaaattagatgcttcyaattttattctctctctataaattt

SEQ ID NO: 3072 - DNA, 50 bp, Artificial Sequence
  synthetic Elaeis guineensis (oil palm) single nucleotide polymorphism (SNP) in genomic region adjacent to shatterproof1 (SHELL) shell thickness gene
gttgattaaaaagatatttaagaamgaaaaaggtggctggagaatattga

SEQ ID NO: 3073 - DNA, 50 bp, Artificial Sequence
  synthetic Elaeis guineensis (oil palm) single nucleotide polymorphism (SNP) in genomic region adjacent to shatterproof1 (SHELL) shell thickness gene
atttgggtggtggtgaaacggtcgsgccaggtgcagcggagctgggcttc

SEQ ID NO: 3074 - DNA, 50 bp, Artificial Sequence
  synthetic Elaeis guineensis (oil palm) single nucleotide polymorphism (SNP) in genomic region adjacent to shatterproof1 (SHELL) shell thickness gene
cgccatttccattcccctgagagamagagagacagagagagatttgggtg

SEQ ID NO: 3075 - DNA, 50 bp, Artificial Sequence
  synthetic Elaeis guineensis (oil palm) single nucleotide polymorphism (SNP) in genomic region adjacent to shatterproof1 (SHELL) shell thickness gene
cacaactttggatacaccaaagccytctatcaccttttcaggaatacaag

SEQ ID NO: 3076 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctcagtcttcgaaattaaactatamtcttcccaaccagttagccctgaga

SEQ ID NO: 3077 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttgtctttaaatttgctggtacatytagtaacaaaaacttaaactcgaca

SEQ ID NO: 3078 - DNA, 50 bp, Artificial Sequence
  synthetic Elaeis guineensis (oil palm) single nucleotide polymorphism (SNP) in genomic region adjacent to shatterproof1 (SHELL) shell thickness gene
acattgaagctaagcaataatggcmtgacaatgcagcaaagcatcattta

SEQ ID NO: 3079 - DNA, 50 bp, Artificial Sequence
  synthetic Elaeis guineensis (oil palm) single nucleotide polymorphism (SNP) in genomic region adjacent to shatterproof1 (SHELL) shell thickness gene
acacattttccataaaaaagattgyaacacctcagtaattagcttctttt

SEQ ID NO: 3080 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgccagaaagcatcccttaacttamaagaaacttgataatttttcctcta

SEQ ID NO: 3081 - DNA, 50 bp, Artificial Sequence
  synthetic Elaeis guineensis (oil palm) single nucleotide polymorphism (SNP) in genomic region adjacent to shatterproof1 (SHELL) shell thickness gene
gagcaaatgcaaaaatagaataggyagacaaaatctgtgggattgccaga

SEQ ID NO: 3082 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctaaatgagcaaatgcaaaaatagrataggcagacaaaatctgtgggatt

SEQ ID NO: 3083 - DNA, 50 bp, Artificial Sequence
  synthetic Elaeis guineensis (oil palm) single nucleotide polymorphism (SNP) in genomic region adjacent to shatterproof1 (SHELL) shell thickness gene
atcgaagataaaagaccgtgtttcycaatattgacccattcatatataaa

SEQ ID NO: 3084 - DNA, 50 bp, Artificial Sequence
  synthetic Elaeis guineensis (oil palm) single nucleotide polymorphism (SNP) in genomic region adjacent to shatterproof1 (SHELL) shell thickness gene
cataatttttgagtatcgaagataraagaccgtgtttcccaatattgacc

SEQ ID NO: 3085 - DNA, 50 bp, Artificial Sequence
  synthetic Elaeis guineensis (oil palm) single nucleotide polymorphism (SNP) in genomic region adjacent to shatterproof1 (SHELL) shell thickness gene
gctggttcataatttttgagtatcraagataaaagaccgtgtttcccaat

SEQ ID NO: 3086 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgcaatagatccgacaaaacgatcsaaagatataaaacacagaacatata

SEQ ID NO: 3087 - DNA, 50 bp, Artificial Sequence
  synthetic Elaeis guineensis (oil palm) single nucleotide polymorphism (SNP) in genomic region adjacent to shatterproof1 (SHELL) shell thickness gene
acagatctcatagaatccagcataygctgtaaaacctggcatacctgtgc

SEQ ID NO: 3088 - DNA, 50 bp, Artificial Sequence
  synthetic Elaeis guineensis (oil palm) single nucleotide polymorphism (SNP) in genomic region adjacent to shatterproof1 (SHELL) shell thickness gene
cttttgccttgtgcctgcacttccwacaacataacagccatgtagctttg

SEQ ID NO: 3089 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatctcaattaaaacaactaatccyaagcacgcatgcgcgcgcgcgcaca

SEQ ID NO: 3090 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttatctcaattaaaacaactaatcycaagcacgcatgcgcgcgcgcgcac

SEQ ID NO: 3091 - DNA, 50 bp, Artificial Sequence
  synthetic Elaeis guineensis (oil palm) single nucleotide polymorphism (SNP) in genomic region adjacent to shatterproof1 (SHELL) shell thickness gene
atagactagatgcaataaactaagycacgactagaaaaattaagatcctc

SEQ ID NO: 3092 - DNA, 50 bp, Artificial Sequence
  synthetic Elaeis guineensis (oil palm) single nucleotide polymorphism (SNP) in genomic region adjacent to shatterproof1 (SHELL) shell thickness gene
taaaatagctttctaagaaccctasaagaagagagggttgataggcagaa

SEQ ID NO: 3093 - DNA, 50 bp, Artificial Sequence
  synthetic Elaeis guineensis (oil palm) single nucleotide polymorphism (SNP) in genomic region adjacent to shatterproof1 (SHELL) shell thickness gene
caggtttgggtcatattttgccaaytaccatgatacaagggtctatggac

SEQ ID NO: 3094 - DNA, 50 bp, Artificial Sequence
  synthetic Elaeis guineensis (oil palm) single nucleotide polymorphism (SNP) in genomic region adjacent to shatterproof1 (SHELL) shell thickness gene
cattacaggagtttcagaatatgaycatttctatcaagataaaatgacaa

SEQ ID NO: 3095 - DNA, 50 bp, Artificial Sequence
  synthetic Elaeis guineensis (oil palm) single nucleotide polymorphism (SNP) in genomic region adjacent to shatterproof1 (SHELL) shell thickness gene
agctcattacaggagtttcagaatwtgatcatttctatcaagataaaatg

SEQ ID NO: 3096 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcaatatacaccacaaccaatgtayaaaaatcacatattatcagctattt

SEQ ID NO: 3097 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttgcaaacactgtacataactgagwcaaacatgttcgaacagcactctaa

SEQ ID NO: 3098 - DNA, 50 bp, Artificial Sequence
  synthetic Elaeis guineensis (oil palm) single nucleotide polymorphism (SNP) in genomic region adjacent to shatterproof1 (SHELL) shell thickness gene
acggtcaaccattgccaccccagckaataaacagcatatgcttctcctta

SEQ ID NO: 3099 - DNA, 50 bp, Artificial Sequence
  synthetic Elaeis guineensis (oil palm) single nucleotide polymorphism (SNP) in genomic region adjacent to shatterproof1 (SHELL) shell thickness gene
agaattgttttctttttggttttascaacttaaaagacacttttgccaaa

SEQ ID NO: 3100 - DNA, 50 bp, Artificial Sequence
  synthetic Elaeis guineensis (oil palm) single nucleotide polymorphism (SNP) in genomic region adjacent to shatterproof1 (SHELL) shell thickness gene
tacaagaaaaccattcgagtctctmctccaacaccaatatctatatatta

SEQ ID NO: 3101 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctcaatttgaatttgatcctacaaraatagtatcctatcattatcctttt

SEQ ID NO: 3102 - DNA, 50 bp, Artificial Sequence
  synthetic Elaeis guineensis (oil palm) single nucleotide polymorphism (SNP) in genomic region adjacent to shatterproof1 (SHELL) shell thickness gene
caaaaatgactcaatttgaatttgrtcctacaagaatagtatcctatcat

SEQ ID NO: 3103 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcataaaaaatatatttttttttawccaacaaaaatgactcaatttgaat

SEQ ID NO: 3104 - DNA, 50 bp, Artificial Sequence
  synthetic Elaeis guineensis (oil palm) single nucleotide polymorphism (SNP) in genomic region adjacent to shatterproof1 (SHELL) shell thickness gene
atatttattttactcttatatttgraaaagatgttgctaagcatatatca

SEQ ID NO: 3105 - DNA, 50 bp, Artificial Sequence
  synthetic Elaeis guineensis (oil palm) single nucleotide polymorphism (SNP) in genomic region adjacent to shatterproof1 (SHELL) shell thickness gene
ataaggaagtaccatttgcgagccmaaaaacgcatattattgaataatca

SEQ ID NO: 3106 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccatcaaatcacagcaacttgtatrcacaattattgaaaggaaaaaagaa

SEQ ID NO: 3107 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcaatcgaataggttagaattaacytcagaaaacgccaatcacttccacc

SEQ ID NO: 3108 - DNA, 50 bp, Artificial Sequence
  synthetic Elaeis guineensis (oil palm) single nucleotide polymorphism (SNP) in genomic region adjacent to shatterproof1 (SHELL) shell thickness gene
cagattatttggcccggaccctcamactacagaactctctcatctaatcc

SEQ ID NO: 3109 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttacagatttaaattaagaggacaygaaatatagtcaacttgccttgacg

SEQ ID NO: 3110 - DNA, 50 bp, Artificial Sequence
  synthetic Elaeis guineensis (oil palm) single nucleotide polymorphism (SNP) in genomic region adjacent to shatterproof1 (SHELL) shell thickness gene
atgaaccttaaataaggcaaaaagwctatagtacttaagctgtccttaca

SEQ ID NO: 3111 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcgaacatagaaacctggatacaakaattcattgtaagtctatatgaacc

SEQ ID NO: 3112 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgtgctatgtatgtgagaggcaggkaaaactgcatctcatgaattgcaaa

SEQ ID NO: 3113 - DNA, 50 bp, Artificial Sequence
  synthetic Elaeis guineensis (oil palm) single nucleotide polymorphism (SNP) in genomic region adjacent to shatterproof1 (SHELL) shell thickness gene
agaagtaaaatttcacttcaggtckgcaatattccatgcaaaacatttca

SEQ ID NO: 3114 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttgctatggttatgattcttaagragtaaaatttcacttcaggtctgca

SEQ ID NO: 3115 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaagaactaaattgaaccgacgtgracccatgaaagaataacataaaaca

SEQ ID NO: 3116 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgagacatgttctaatagaggaggyggaaagcaattggagaaaagtttca

SEQ ID NO: 3117 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttaccatcggatgggatgatgccckgcttcatgattaagtagtcaacgtg

SEQ ID NO: 3118 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccagacactatgtgggtggtgcatwctaaaatgaagctattatgactttt

SEQ ID NO: 3119 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaacaccataaaggaaattctgctkgcattatccagacactatgtgggtg

SEQ ID NO: 3120 - DNA, 50 bp, Artificial Sequence
  synthetic Elaeis guineensis (oil palm) single nucleotide polymorphism (SNP) in genomic region adjacent to shatterproof1 (SHELL) shell thickness gene
ataacatttaagaaaaacagatagktcaataacattaattctgagtgttg

SEQ ID NO: 3121 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatttacagtgtcataatttcatawtcttaataaaaaccatcttaactaa

SEQ ID NO: 3122 - DNA, 50 bp, Artificial Sequence
  synthetic Elaeis guineensis (oil palm) single nucleotide polymorphism (SNP) in genomic region adjacent to shatterproof1 (SHELL) shell thickness gene
cttttctcaacattaattcttgtcmaatagatgaatagaatcgaagcaaa

SEQ ID NO: 3123 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggtgtaagagggaatcagtgttgtrgaaaagcaaagaacttttctcaaca

SEQ ID NO: 3124 - DNA, 50 bp, Artificial Sequence
  synthetic Elaeis guineensis (oil palm) single nucleotide polymorphism (SNP) in genomic region adjacent to shatterproof1 (SHELL) shell thickness gene
gattttggataccctagccctagaygattatcataattttgttcaacacc

SEQ ID NO: 3125 - DNA, 50 bp, Artificial Sequence
  synthetic Elaeis guineensis (oil palm) single nucleotide polymorphism (SNP) in genomic region adjacent to shatterproof1 (SHELL) shell thickness gene
tactacaatttcttaggagattttkgataccctagccctagatgattatc

SEQ ID NO: 3126 - DNA, 50 bp, Artificial Sequence
  synthetic Elaeis guineensis (oil palm) single nucleotide polymorphism (SNP) in genomic region adjacent to shatterproof1 (SHELL) shell thickness gene
caatgtttaagagtcatgggacagktaaaaagaaaaagttagttgctgca

SEQ ID NO: 3127 - DNA, 50 bp, Artificial Sequence
  synthetic Elaeis guineensis (oil palm) single nucleotide polymorphism (SNP) in genomic region adjacent to shatterproof1 (SHELL) shell thickness gene
atgtatttccatatcaatttcaatsttttgggggttattttggatacaat

SEQ ID NO: 3128 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttctagatgatctaggattttggamtccattaatcacaggatggaatgta

SEQ ID NO: 3129 - DNA, 50 bp, Artificial Sequence
  synthetic Elaeis guineensis (oil palm) single nucleotide polymorphism (SNP) in genomic region adjacent to shatterproof1 (SHELL) shell thickness gene
acattagaacactatgttcatatcyacatttcctgttgtttatgaaggga

SEQ ID NO: 3130 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcttgttggtgatagacattagaayactatgttcatatctacatttcctg

SEQ ID NO: 3131 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcctcggttcagatgacaaagattyaggtagagagaaacaacaaaatctt

SEQ ID NO: 3132 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttttgcagcaagaagaacatttcraaagagcattgatgtgtagaagtta

SEQ ID NO: 3133 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcgatgcaaagaaacatgctactckaaagaatatgaaggtgaaaaccatg

SEQ ID NO: 3134 - DNA, 50 bp, Artificial Sequence
  synthetic Elaeis guineensis (oil palm) single nucleotide polymorphism (SNP) in genomic region adjacent to shatterproof1 (SHELL) shell thickness gene
caaaagaatataaaggtaatcgatscaaagaaacatgctactcgaaagaa

SEQ ID NO: 3135 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcattccttggagctttactatgayggacatatcatagaaaacataattt

SEQ ID NO: 3136 - DNA, 50 bp, Artificial Sequence
  synthetic Elaeis guineensis (oil palm) single nucleotide polymorphism (SNP) in genomic region adjacent to shatterproof1 (SHELL) shell thickness gene
caagcttcaaagaaagcattgtcakgagatcaaaatggacccatgcaata

SEQ ID NO: 3137 - DNA, 50 bp, Artificial Sequence
  synthetic Elaeis guineensis (oil palm) single nucleotide polymorphism (SNP) in genomic region adjacent to shatterproof1 (SHELL) shell thickness gene
tattcacatccaactccaacatgayaagcttcaaagaaagcattgtcagg

SEQ ID NO: 3138 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagaagaacaagttttccttctatkctctatacaaagggcactgatcaag

SEQ ID NO: 3139 - DNA, 50 bp, Artificial Sequence
  synthetic Elaeis guineensis (oil palm) single nucleotide polymorphism (SNP) in genomic region adjacent to shatterproof1 (SHELL) shell thickness gene
tacatacgtaagcatgttattatgytgtaatttgtctgaatctatttgtt

SEQ ID NO: 3140 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagacaggcagacatagtgcactcrttcagatgctatcatgtactcaggg

SEQ ID NO: 3141 - DNA, 50 bp, Artificial Sequence
  synthetic Elaeis guineensis (oil palm) single nucleotide polymorphism (SNP) in genomic region adjacent to shatterproof1 (SHELL) shell thickness gene
atatgtattccaaccatatattaaratagaaggatatataagtacactct

SEQ ID NO: 3142 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtatatgatgaaagtggaaaatatrtcagccttctttttccttcttttct

SEQ ID NO: 3143 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaaaatatgtatatgatgaaagtgraaaatatgtcagccttctttttcct

SEQ ID NO: 3144 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggagtatttcatgtaggcattttcracatactgtaagaaaaaaatgaatg

SEQ ID NO: 3145 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgtgtctttccaccatccctgtttrgcacaagtggcatatgttttgtcca

SEQ ID NO: 3146 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaagcttaaatgtgtctttccaccrtccctgtttggcacaagtggcatat

SEQ ID NO: 3147 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcttaaggatgtcttcttaattagmaaaagaaaaaggaaaaaaggaattg

SEQ ID NO: 3148 - DNA, 50 bp, Artificial Sequence
  synthetic Elaeis guineensis (oil palm) single nucleotide polymorphism (SNP) in genomic region adjacent to shatterproof1 (SHELL) shell thickness gene
caaagagttagtggatggatggagrtttttatcaaacctatttattagaa

SEQ ID NO: 3149 - DNA, 50 bp, Artificial Sequence
  synthetic Elaeis guineensis (oil palm) single nucleotide polymorphism (SNP) in genomic region adjacent to shatterproof1 (SHELL) shell thickness gene
gagttttgtattagataaaagaccwattttgattcaaaaacaaatcaaca

SEQ ID NO: 3150 - DNA, 50 bp, Artificial Sequence
  synthetic Elaeis guineensis (oil palm) single nucleotide polymorphism (SNP) in genomic region adjacent to shatterproof1 (SHELL) shell thickness gene
acaagaatacatcataattttcaarcatatgttgttgaaagaagcttatt

SEQ ID NO: 3151 - DNA, 50 bp, Artificial Sequence
  synthetic Elaeis guineensis (oil palm) single nucleotide polymorphism (SNP) in genomic region adjacent to shatterproof1 (SHELL) shell thickness gene
cacctgcccatattgcatcactagwatcctacaaaaggggtgcaagtaca

SEQ ID NO: 3152 - DNA, 50 bp, Artificial Sequence
  synthetic Elaeis guineensis (oil palm) single nucleotide polymorphism (SNP) in genomic region adjacent to shatterproof1 (SHELL) shell thickness gene
atataatctattataatattattayattataataatacaatataacataa

SEQ ID NO: 3153 - DNA, 50 bp, Artificial Sequence
  synthetic Elaeis guineensis (oil palm) single nucleotide polymorphism (SNP) in genomic region adjacent to shatterproof1 (SHELL) shell thickness gene
attatagtatatattatattatatkatatgataataatatgatacaataa

SEQ ID NO: 3154 - DNA, 50 bp, Artificial Sequence
  synthetic Elaeis guineensis (oil palm) single nucleotide polymorphism (SNP) in genomic region adjacent to shatterproof1 (SHELL) shell thickness gene
taatataataataaattaatattaygatatattataaatatataatataa

SEQ ID NO: 3155 - DNA, 50 bp, Artificial Sequence
  synthetic Elaeis guineensis (oil palm) single nucleotide polymorphism (SNP) in genomic region adjacent to shatterproof1 (SHELL) shell thickness gene
catccttccaatggtggaactttayggcccagtccgaccttgaaaaaaga

SEQ ID NO: 3156 - DNA, 50 bp, Artificial Sequence
  synthetic Elaeis guineensis (oil palm) single nucleotide polymorphism (SNP) in genomic region adjacent to shatterproof1 (SHELL) shell thickness gene
taagctcgaggaaattcttatatcygcccaaagtagtttcaaacccagcc

SEQ ID NO: 3157 - DNA, 50 bp, Artificial Sequence
  synthetic Elaeis guineensis (oil palm) single nucleotide polymorphism (SNP) in genomic region adjacent to shatterproof1 (SHELL) shell thickness gene
atcggctgtggtgctagttagctgytgctgttctcttcttgagaggttct

SEQ ID NO: 3158 - DNA, 50 bp, Artificial Sequence
  synthetic Elaeis guineensis (oil palm) single nucleotide polymorphism (SNP) in genomic region adjacent to shatterproof1 (SHELL) shell thickness gene
taaaaactgcaaaaggaaccagccwgaagatatcggctgtggtgctagtt

SEQ ID NO: 3159 - DNA, 50 bp, Artificial Sequence
  synthetic Elaeis guineensis (oil palm) single nucleotide polymorphism (SNP) in genomic region adjacent to shatterproof1 (SHELL) shell thickness gene
cgtgagtctttgacttcttttgccrtttctttcactgtatcctgtaaaaa

SEQ ID NO: 3160 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatttagttcaaatgctcatgacgytaaaaaagcaaacagaagaagtgaa

SEQ ID NO: 3161 - DNA, 50 bp, Artificial Sequence
  synthetic Elaeis guineensis (oil palm) single nucleotide polymorphism (SNP) in genomic region adjacent to shatterproof1 (SHELL) shell thickness gene
gttccatatggtgggattcccatawacttacacatattaaccaatcttgg

SEQ ID NO: 3162 - DNA, 50 bp, Artificial Sequence
  synthetic Elaeis guineensis (oil palm) single nucleotide polymorphism (SNP) in genomic region adjacent to shatterproof1 (SHELL) shell thickness gene
aataattttcttcgaagcataaacygcaaataattatctgttccatatgg

SEQ ID NO: 3163 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggatgatgcattttctttgaacttyaaaaacatataacctaccaaaataa

SEQ ID NO: 3164 - DNA, 50 bp, Artificial Sequence
  synthetic Elaeis guineensis (oil palm) single nucleotide polymorphism (SNP) in genomic region adjacent to shatterproof1 (SHELL) shell thickness gene
cgggcaagccatgggctgaccctgstcagtgtgcactcctaagtgaggtg

SEQ ID NO: 3165 - DNA, 50 bp, Artificial Sequence
  synthetic Elaeis guineensis (oil palm) single nucleotide polymorphism (SNP) in genomic region adjacent to shatterproof1 (SHELL) shell thickness gene
caacccataccataaaaatattggyccaaccttcttatgatgtatgctgg

SEQ ID NO: 3166 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctcataaatcattggcccaagcctrgcctaattttagttgggccaaaact

SEQ ID NO: 3167 - DNA, 50 bp, Artificial Sequence
  synthetic Elaeis guineensis (oil palm) single nucleotide polymorphism (SNP) in genomic region adjacent to shatterproof1 (SHELL) shell thickness gene
atatatatgccaactgtacatataygtgctatagaagtattgcctcaggc

SEQ ID NO: 3168 - DNA, 50 bp, Artificial Sequence
  synthetic Elaeis guineensis (oil palm) single nucleotide polymorphism (SNP) in genomic region adjacent to shatterproof1 (SHELL) shell thickness gene
aactttccagctttttagaaatctraaagcacttcttaatattttaccaa

SEQ ID NO: 3169 - DNA, 50 bp, Artificial Sequence
  synthetic Elaeis guineensis (oil palm) single nucleotide polymorphism (SNP) in genomic region adjacent to shatterproof1 (SHELL) shell thickness gene
tccaaaatagaactttcccaagtakaactttccagctttttagaaatctg

SEQ ID NO: 3170 - DNA, 50 bp, Artificial Sequence
  synthetic Elaeis guineensis (oil palm) single nucleotide polymorphism (SNP) in genomic region adjacent to shatterproof1 (SHELL) shell thickness gene
cttccaaacatcagtcaagtagggytcttgagaaaatctccaaaatagaa

SEQ ID NO: 3171 - DNA, 50 bp, Artificial Sequence
  synthetic Elaeis guineensis (oil palm) single nucleotide polymorphism (SNP) in genomic region adjacent to shatterproof1 (SHELL) shell thickness gene
tattataatataatgtcattatgtygctacgaaattttcattaaaaaaca

SEQ ID NO: 3172 - DNA, 50 bp, Artificial Sequence
  synthetic Elaeis guineensis (oil palm) single nucleotide polymorphism (SNP) in genomic region adjacent to shatterproof1 (SHELL) shell thickness gene
atattattataatataatgtcattrtgttgctacgaaattttcattaaaa

SEQ ID NO: 3173 - DNA, 50 bp, Artificial Sequence
  synthetic Elaeis guineensis (oil palm) single nucleotide polymorphism (SNP) in genomic region adjacent to shatterproof1 (SHELL) shell thickness gene
atctcctttatcacagagtgaaagkttgagaaagtacttttggtatgaca

SEQ ID NO: 3174 - DNA, 50 bp, Artificial Sequence
  synthetic Elaeis guineensis (oil palm) single nucleotide polymorphism (SNP) in genomic region adjacent to shatterproof1 (SHELL) shell thickness gene
tattcaagtataatgtcacaatggrttttttaactagaagtatctccttt

SEQ ID NO: 3175 - DNA, 50 bp, Artificial Sequence
  synthetic Elaeis guineensis (oil palm) single nucleotide polymorphism (SNP) in genomic region adjacent to shatterproof1 (SHELL) shell thickness gene
taatacgacatattttatcaaaagsaatggcaattaactatgcaaacaac

SEQ ID NO: 3176 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatattcaatatcaatctcccaatytttgcacattatttcacatcatgaa

SEQ ID NO: 3177 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccttccagacctccaaagaataatrttcaatatcaatctcccaatttttg

SEQ ID NO: 3178 - DNA, 50 bp, Artificial Sequence
  synthetic Elaeis guineensis (oil palm) single nucleotide polymorphism (SNP) in genomic region adjacent to shatterproof1 (SHELL) shell thickness gene
ataataacttggagagcttagtaayattgatttctataatattgtgttta

SEQ ID NO: 3179 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcacaacatataataacttggagascttagtaacattgatttctataata

SEQ ID NO: 3180 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgtctgcttaagaaacacaaacaarcatcacaacatataataacttggag

SEQ ID NO: 3181 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgcaaaaaagaggtcacattcataygttacaatgaatcacaagtaatatt

SEQ ID NO: 3182 - DNA, 50 bp, Artificial Sequence
  synthetic Elaeis guineensis (oil palm) single nucleotide polymorphism (SNP) in genomic region adjacent to shatterproof1 (SHELL) shell thickness gene
acacaatataacatggagatcatcrtcactaggcacaatcatctaaatat

SEQ ID NO: 3183 - DNA, 50 bp, Artificial Sequence
  synthetic Elaeis guineensis (oil palm) single nucleotide polymorphism (SNP) in genomic region adjacent to shatterproof1 (SHELL) shell thickness gene
catggtaccagtacaggtctggtaytgagattgtgaacattgactaaatg

SEQ ID NO: 3184 - DNA, 50 bp, Artificial Sequence
  synthetic Elaeis guineensis (oil palm) single nucleotide polymorphism (SNP) in genomic region adjacent to shatterproof1 (SHELL) shell thickness gene
catcgtcctaattttaccacctagyaccgtcatattaactagcaagattc

SEQ ID NO: 3185 - DNA, 50 bp, Artificial Sequence
  synthetic Elaeis guineensis (oil palm) single nucleotide polymorphism (SNP) in genomic region adjacent to shatterproof1 (SHELL) shell thickness gene
atcatgtagttacaatcttcaaaascagccactcttattacctctctctt

SEQ ID NO: 3186 - DNA, 50 bp, Artificial Sequence
  synthetic Elaeis guineensis (oil palm) single nucleotide polymorphism (SNP) in genomic region adjacent to shatterproof1 (SHELL) shell thickness gene
cttctgaagtatgtgttatcttccraggtccttcaagctgcagaatctgc

SEQ ID NO: 3187 - DNA, 50 bp, Artificial Sequence
  synthetic Elaeis guineensis (oil palm) single nucleotide polymorphism (SNP) in genomic region adjacent to shatterproof1 (SHELL) shell thickness gene
cttccatgcaaaaggggggtggtckgcaaactatgccactttaacaccat

SEQ ID NO: 3188 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtggatcattatcaaattcagattwtatatatatatatataaagcccgga

SEQ ID NO: 3189 - DNA, 50 bp, Artificial Sequence
  synthetic Elaeis guineensis (oil palm) single nucleotide polymorphism (SNP) in genomic region adjacent to shatterproof1 (SHELL) shell thickness gene
agactgaattctagacaaagagagytgaaattaattaaaagaagcagtga

SEQ ID NO: 3190 - DNA, 50 bp, Artificial Sequence
  synthetic Elaeis guineensis (oil palm) single nucleotide polymorphism (SNP) in genomic region adjacent to shatterproof1 (SHELL) shell thickness gene
catgcttgcctaagttcacattctraaagagattctacaccctctgcctg

SEQ ID NO: 3191 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggtccctacatgcttgcctaagttmacattctaaaagagattctacaccc

SEQ ID NO: 3192 - DNA, 50 bp, Artificial Sequence
  synthetic Elaeis guineensis (oil palm) single nucleotide polymorphism (SNP) in genomic region adjacent to shatterproof1 (SHELL) shell thickness gene
caggcataagaaaactttaagagayttgtttttaattgggtctatcattt

SEQ ID NO: 3193 - DNA, 50 bp, Artificial Sequence
  synthetic Elaeis guineensis (oil palm) single nucleotide polymorphism (SNP) in genomic region adjacent to shatterproof1 (SHELL) shell thickness gene
ataagcaaagaatttccttagtacmggcataagaaaactttaagagactt

SEQ ID NO: 3194 - DNA, 50 bp, Artificial Sequence
  synthetic Elaeis guineensis (oil palm) single nucleotide polymorphism (SNP) in genomic region adjacent to shatterproof1 (SHELL) shell thickness gene
acagtagactctagaaatgctattwagtataaagaaaataattgcagtaa

SEQ ID NO: 3195 - DNA, 50 bp, Artificial Sequence
  synthetic Elaeis guineensis (oil palm) single nucleotide polymorphism (SNP) in genomic region adjacent to shatterproof1 (SHELL) shell thickness gene
aggtgaggacgtcaaatcagactcrgcaaagttttagtaaaatgctgaaa

SEQ ID NO: 3196 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctaagaaatgacatccaaattaawcaggaggaaacaacatatatttaaa

SEQ ID NO: 3197 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatttccagaaacagtgaaagctcyaagaaatgacatccaaattaatcag

SEQ ID NO: 3198 - DNA, 50 bp, Artificial Sequence
  synthetic Elaeis guineensis (oil palm) single nucleotide polymorphism (SNP) in genomic region adjacent to shatterproof1 (SHELL) shell thickness gene
cattaatctcccaatactgatactmaacaaataaggtaatgataaaggaa

SEQ ID NO: 3199 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttacatttcaagcttatgcaactasgaacagcattctaagataaacttga

SEQ ID NO: 3200 - DNA, 50 bp, Artificial Sequence
  synthetic Elaeis guineensis (oil palm) single nucleotide polymorphism (SNP) in genomic region adjacent to shatterproof1 (SHELL) shell thickness gene
agcaaatcatcaagaccattggttwacctgatgtcaatccctaacaaatt

SEQ ID NO: 3201 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccagtagcaaacaatttaacataaktaactagaccaatagatatgaacca

SEQ ID NO: 3202 - DNA, 50 bp, Artificial Sequence
  synthetic Elaeis guineensis (oil palm) single nucleotide polymorphism (SNP) in genomic region adjacent to shatterproof1 (SHELL) shell thickness gene
tagaaacatgctttaacaattgcastcatacaacattggcttgctaatga

SEQ ID NO: 3203 - DNA, 50 bp, Artificial Sequence
  synthetic Elaeis guineensis (oil palm) single nucleotide polymorphism (SNP) in genomic region adjacent to shatterproof1 (SHELL) shell thickness gene
agtagagtgcaagattatacagatytactcacaattaattctgcaggaaa

SEQ ID NO: 3204 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatgatcatctagtcttccaatgtyttgatttatgttgtctgcttctaca

SEQ ID NO: 3205 - DNA, 50 bp, Artificial Sequence
  synthetic Elaeis guineensis (oil palm) single nucleotide polymorphism (SNP) in genomic region adjacent to shatterproof1 (SHELL) shell thickness gene
actgaagtttagactttaagtcttkgagactaataatgttttgcattaga

SEQ ID NO: 3206 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgagcatgagaacatctcgtgacastacaaagataataagagctaaatag

SEQ ID NO: 3207 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatctgacctaataatctggagctsgatacactcactcatacaggaaaat

SEQ ID NO: 3208 - DNA, 50 bp, Artificial Sequence
  synthetic Elaeis guineensis (oil palm) single nucleotide polymorphism (SNP) in genomic region adjacent to shatterproof1 (SHELL) shell thickness gene
caatgaaatcacatcatctatcatwtgcgccacagtgaatttgaattcat

SEQ ID NO: 3209 - DNA, 50 bp, Artificial Sequence
  synthetic Elaeis guineensis (oil palm) single nucleotide polymorphism (SNP) in genomic region adjacent to shatterproof1 (SHELL) shell thickness gene
aacaatatcaaatcacatgcaaacwgttttcgagtttgatacatgaaaga

SEQ ID NO: 3210 - DNA, 50 bp, Artificial Sequence
  synthetic Elaeis guineensis (oil palm) single nucleotide polymorphism (SNP) in genomic region adjacent to shatterproof1 (SHELL) shell thickness gene
gctgaagctagaacagctaatgcayggctgattttacagaggtcttctct

SEQ ID NO: 3211 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttaacaagactcaagaactcttgaygctccctgctgacagactgcaaggt

SEQ ID NO: 3212 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagatgaaatatacctctttgttarcaagactcaagaactcttgacgctc

SEQ ID NO: 3213 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggtcagtattctccctgactgcacyatatgctttcttagctgcttctcat

SEQ ID NO: 3214 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaagcatgcggagaaaatgtcaayaccatttagttaaatatgtttccaa

SEQ ID NO: 3215 - DNA, 50 bp, Artificial Sequence
  synthetic Elaeis guineensis (oil palm) single nucleotide polymorphism (SNP) in genomic region adjacent to shatterproof1 (SHELL) shell thickness gene
catggtgcacatttgcacatactcrgtatatggaagggttgtgataggaa

SEQ ID NO: 3216 - DNA, 50 bp, Artificial Sequence
  synthetic Elaeis guineensis (oil palm) single nucleotide polymorphism (SNP) in genomic region adjacent to shatterproof1 (SHELL) shell thickness gene
gttctagaaaataagaaaaacatamtgaaaacaagggatttgtaattggt

SEQ ID NO: 3217 - DNA, 50 bp, Artificial Sequence
  synthetic Elaeis guineensis (oil palm) single nucleotide polymorphism (SNP) in genomic region adjacent to shatterproof1 (SHELL) shell thickness gene
aattctcccaagaaactttataacygatactgttacatccaccttaagaa

SEQ ID NO: 3218 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcattatataatcccctatcccccraaagaagtatcgaaggaagaaatat

SEQ ID NO: 3219 - DNA, 50 bp, Artificial Sequence
  synthetic Elaeis guineensis (oil palm) single nucleotide polymorphism (SNP) in genomic region adjacent to shatterproof1 (SHELL) shell thickness gene
aacaaaaagcaaagaataattaccygtcaagtagctgccagcagttacca

SEQ ID NO: 3220 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaataaagttttagtagataggccractaagttgtggaacaactgaatag

SEQ ID NO: 3221 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttcatgatataacaccaaaaacaasaaatatagttgttttaaattcgaat

SEQ ID NO: 3222 - DNA, 50 bp, Artificial Sequence
  synthetic Elaeis guineensis (oil palm) single nucleotide polymorphism (SNP) in genomic region adjacent to shatterproof1 (SHELL) shell thickness gene
catagagtgtctgagggaaaaagckaatctgcataaaatattcatgatat

SEQ ID NO: 3223 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaagtagcatagagtgtctgagggraaaagcgaatctgcataaaatattc

SEQ ID NO: 3224 - DNA, 50 bp, Artificial Sequence
  synthetic Elaeis guineensis (oil palm) single nucleotide polymorphism (SNP) in genomic region adjacent to shatterproof1 (SHELL) shell thickness gene
agaaaaaccaaagaggcaaaattaraaagtgtcttggtctacagccatgt

SEQ ID NO: 3225 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcatagagtgagaaatttcaaatayggaaaaaaagaaatcatcagttaca

SEQ ID NO: 3226 - DNA, 50 bp, Artificial Sequence
  synthetic Elaeis guineensis (oil palm) single nucleotide polymorphism (SNP) in genomic region adjacent to shatterproof1 (SHELL) shell thickness gene
atggctgcagctgcaacctcttctrgtgtcactttgccatcatgatcact

SEQ ID NO: 3227 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcaatcaacctctatccctagaaakgttgctgatgagttcctggacatcc

SEQ ID NO: 3228 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctgtttcatctccattggcatcakctatttgactgcctagcttgactat

SEQ ID NO: 3229 - DNA, 50 bp, Artificial Sequence
  synthetic Elaeis guineensis (oil palm) single nucleotide polymorphism (SNP) in genomic region adjacent to shatterproof1 (SHELL) shell thickness gene
caattgtattaccaacgactgaagytctgtttcatctccattggcatcat

SEQ ID NO: 3230 - DNA, 50 bp, Artificial Sequence
  synthetic Elaeis guineensis (oil palm) single nucleotide polymorphism (SNP) in genomic region adjacent to shatterproof1 (SHELL) shell thickness gene
actatcttatataaccacatatatmcataggttattttgaccaggccacc

SEQ ID NO: 3231 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccctagaaaaaaataaaaataaaargatgaataaactgaacatgggttca

SEQ ID NO: 3232 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcagccaaaacaactaacagctacratgcatgcaataaatatggggcccc

SEQ ID NO: 3233 - DNA, 50 bp, Artificial Sequence
  synthetic Elaeis guineensis (oil palm) single nucleotide polymorphism (SNP) in genomic region adjacent to shatterproof1 (SHELL) shell thickness gene
atatcgttagctaatcagccaaaamaactaacagctacaatgcatgcaat

SEQ ID NO: 3234 - DNA, 50 bp, Artificial Sequence
  synthetic Elaeis guineensis (oil palm) single nucleotide polymorphism (SNP) in genomic region adjacent to shatterproof1 (SHELL) shell thickness gene
gacattggacagaaacggcactccsagaattacgctaacaaaatgctgca

SEQ ID NO: 3235 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccaaaagacattggacagaaacggyactccgagaattacgctaacaaaat

SEQ ID NO: 3236 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcacaaataaatgtagggtcatgcygaaccggcatatctccaaagcctca

SEQ ID NO: 3237 - DNA, 50 bp, Artificial Sequence
  synthetic Elaeis guineensis (oil palm) single nucleotide polymorphism (SNP) in genomic region adjacent to shatterproof1 (SHELL) shell thickness gene
gctcattctatttgtaatgagagtkggagaaaactttgggttggttaccg

SEQ ID NO: 3238 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcaaagcccacagctataatgcttractgaagcttaatgcctgcgagtct

SEQ ID NO: 3239 - DNA, 50 bp, Artificial Sequence
  synthetic Elaeis guineensis (oil palm) single nucleotide polymorphism (SNP) in genomic region adjacent to shatterproof1 (SHELL) shell thickness gene
atctcaaggtcgaaagatgaatacrgaaaagagacaaactactctcggaa

SEQ ID NO: 3240 - DNA, 50 bp, Artificial Sequence
  synthetic Elaeis guineensis (oil palm) single nucleotide polymorphism (SNP) in genomic region adjacent to shatterproof1 (SHELL) shell thickness gene
acaaaaccacaagatggactggttytcaaatctcaaggtcgaaagatgaa

SEQ ID NO: 3241 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagaccaatccaccaacccactgcwagttaacactggtgaattggaatgg

SEQ ID NO: 3242 - DNA, 50 bp, Artificial Sequence
  synthetic Elaeis guineensis (oil palm) single nucleotide polymorphism (SNP) in genomic region adjacent to shatterproof1 (SHELL) shell thickness gene
taatggagagcacaagaagaccaakccaccaacccactgctagttaacac

SEQ ID NO: 3243 - DNA, 50 bp, Artificial Sequence
  synthetic Elaeis guineensis (oil palm) single nucleotide polymorphism (SNP) in genomic region adjacent to shatterproof1 (SHELL) shell thickness gene
agcgaacggatgagaggaaattctyaatggagagcacaagaagaccaatc

SEQ ID NO: 3244 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatagagagcgaatctcctgttcarttggaatcctagggagacaaacagg

SEQ ID NO: 3245 - DNA, 50 bp, Artificial Sequence
  synthetic Elaeis guineensis (oil palm) single nucleotide polymorphism (SNP) in genomic region adjacent to shatterproof1 (SHELL) shell thickness gene
taactcagcaacgtcatagtaactmaaatggagtcttgttccaagaatgt

SEQ ID NO: 3246 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagaaccattccgacatcctaactyagcaacgtcatagtaactaaaatgg

SEQ ID NO: 3247 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttgcattatgttttttttttttcaraccaactagaggaacgctataaatc

SEQ ID NO: 3248 - DNA, 50 bp, Artificial Sequence
  synthetic Elaeis guineensis (oil palm) single nucleotide polymorphism (SNP) in genomic region adjacent to shatterproof1 (SHELL) shell thickness gene
atcgtctaatatgtgttatacagcycatattgcattatgttttttttttt

SEQ ID NO: 3249 - DNA, 50 bp, Artificial Sequence
  synthetic Elaeis guineensis (oil palm) single nucleotide polymorphism (SNP) in genomic region adjacent to shatterproof1 (SHELL) shell thickness gene
agccgttctttttatcgtctaataygtgttatacagcccatattgcatta

SEQ ID NO: 3250 - DNA, 50 bp, Artificial Sequence
  synthetic Elaeis guineensis (oil palm) single nucleotide polymorphism (SNP) in genomic region adjacent to shatterproof1 (SHELL) shell thickness gene
actacataaccctcgcgtctttttrgaatggagatcaagctacatctcgt

SEQ ID NO: 3251 - DNA, 50 bp, Artificial Sequence
  synthetic Elaeis guineensis (oil palm) single nucleotide polymorphism (SNP) in genomic region adjacent to shatterproof1 (SHELL) shell thickness gene
agaaaggaagatgaaagtaaagggwaagttcgatattttttaaaataaga

SEQ ID NO: 3252 - DNA, 50 bp, Artificial Sequence
  synthetic Elaeis guineensis (oil palm) single nucleotide polymorphism (SNP) in genomic region adjacent to shatterproof1 (SHELL) shell thickness gene
attccatcgaaaaccttccgcacartctccaaatcgccgttgtttataaa

SEQ ID NO: 3253 - DNA, 50 bp, Artificial Sequence
  synthetic Elaeis guineensis (oil palm) single nucleotide polymorphism (SNP) in genomic region adjacent to shatterproof1 (SHELL) shell thickness gene
agaaactatatctcttagccattcyatcgaaaaccttccgcacaatctcc

SEQ ID NO: 3254 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcagcccatatctcgcatacccatyaaccataatgctccaagaaactata

SEQ ID NO: 3255 - DNA, 50 bp, Artificial Sequence
  synthetic Elaeis guineensis (oil palm) single nucleotide polymorphism (SNP) in genomic region adjacent to shatterproof1 (SHELL) shell thickness gene
gttatacagctcatattgcattatktttttatttttcagaccaactagaa

SEQ ID NO: 3256 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtcaataaagaatgccaagaaagtrttatagttcggacactgatggtaaa

SEQ ID NO: 3257 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttaatttatgtcaataaagaatgcyaagaaagtgttatagttcggacact

SEQ ID NO: 3258 - DNA, 50 bp, Artificial Sequence; identical to SEQ ID NO: 3256
  synthetic Elaeis guineensis (oil palm) single nucleotide polymorphism (SNP) in genomic region adjacent to shatterproof1 (SHELL) shell thickness gene

SEQ ID NO: 3259 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaatatcaatgaattctatgaaaaytgattcctcttgggcattgcatcaa

SEQ ID NO: 3260 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaatgaagtcaaaaaagggaccagmagttaattacctattatttttgttc

SEQ ID NO: 3261 - DNA, 50 bp, Artificial Sequence
  synthetic Elaeis guineensis (oil palm) single nucleotide polymorphism (SNP) in genomic region adjacent to shatterproof1 (SHELL) shell thickness gene
cggagtccattttctcttttatgtwgaaggaaagggaggaacgaaggaaa

SEQ ID NO: 3262 - DNA, 50 bp, Artificial Sequence
  synthetic Elaeis guineensis (oil palm) single nucleotide polymorphism (SNP) in genomic region adjacent to shatterproof1 (SHELL) shell thickness gene
agggagagcagcctccaacataacygacaccttgtggagaagaacaaaga

SEQ ID NO: 3263 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccattccatcgaaaaccttccgcgyagtctccaaatcgctgttgtttata

SEQ ID NO: 3264 - DNA, 50 bp, Artificial Sequence
  synthetic Elaeis guineensis (oil palm) single nucleotide polymorphism (SNP) in genomic region adjacent to shatterproof1 (SHELL) shell thickness gene
agaaactatatctcttagccattcyatcgaaaaccttccgcgcagtctcc

SEQ ID NO: 3265 - DNA, 50 bp, Artificial Sequence
  synthetic Elaeis guineensis (oil palm) single nucleotide polymorphism (SNP) in genomic region adjacent to shatterproof1 (SHELL) shell thickness gene
tccacgctaccatatctcgagtacytgaatatcaatgaattctatgaaaa

SEQ ID NO: 3266 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaggtccaaggcttccttgaaccrgccattctgtgtgtatcccgagatc

SEQ ID NO: 3267 - DNA, 50 bp, Artificial Sequence
  synthetic Elaeis guineensis (oil palm) single nucleotide polymorphism (SNP) in genomic region adjacent to shatterproof1 (SHELL) shell thickness gene
accactaaaagaatgcttacaagcrtgattttatttggtgccacacctgc

SEQ ID NO: 3268 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcaaccactaaaagaatgcttacargcgtgattttatttggtgccacacc

SEQ ID NO: 3269 - DNA, 50 bp, Artificial Sequence
  synthetic Elaeis guineensis (oil palm) single nucleotide polymorphism (SNP) in genomic region adjacent to shatterproof1 (SHELL) shell thickness gene
tagagccgaatcaaggatcaagtcyacttccatacccatctatccatgta

SEQ ID NO: 3270 - DNA, 50 bp, Artificial Sequence
  synthetic Elaeis guineensis (oil palm) single nucleotide polymorphism (SNP) in genomic region adjacent to shatterproof1 (SHELL) shell thickness gene
cactagagccgaatcaaggatcaartccacttccatacccatctatccat

SEQ ID NO: 3271 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctatgcttgagcttttcaaagatgytagcagcatcctcaatgcagccaca

SEQ ID NO: 3272 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatgttaatttaattgtgtaccaarctgataattctctatgcttgagctt

SEQ ID NO: 3273 - DNA, 50 bp, Artificial Sequence
  synthetic Elaeis guineensis (oil palm) single nucleotide polymorphism (SNP) in genomic region adjacent to shatterproof1 (SHELL) shell thickness gene
actgtgtactatattcatttaattrtgtaccatatttagttaactgtgta

SEQ ID NO: 3274 - DNA, 50 bp, Artificial Sequence
  synthetic Elaeis guineensis (oil palm) single nucleotide polymorphism (SNP) in genomic region adjacent to shatterproof1 (SHELL) shell thickness gene
gttactttaactgtgtatattattyatttaactatgtgcagtgttcattt

SEQ ID NO: 3275 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtatcatgttactttaactgtgtayattatttatttaactatgtgcagtg

SEQ ID NO: 3276 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatataccatagttaattaactgtrtgccatgttaatttaactgtgtata

SEQ ID NO: 3277 - DNA, 50 bp, Artificial Sequence
  synthetic Elaeis guineensis (oil palm) single nucleotide polymorphism (SNP) in genomic region adjacent to shatterproof1 (SHELL) shell thickness gene
catatttatttaactgtgtactatrtttatttaactatataccatagtta

SEQ ID NO: 3278 - DNA, 50 bp, Artificial Sequence
  synthetic Elaeis guineensis (oil palm) single nucleotide polymorphism (SNP) in genomic region adjacent to shatterproof1 (SHELL) shell thickness gene
atatagtatttatttgactatgtaytatattaatttaactatataccata

SEQ ID NO: 3279 - DNA, 50 bp, Artificial Sequence
  synthetic Elaeis guineensis (oil palm) single nucleotide polymorphism (SNP) in genomic region adjacent to shatterproof1 (SHELL) shell thickness gene
actatgtatattattaatttaactrtgtacaatatttattaaattgtgta

SEQ ID NO: 3280 - DNA, 50 bp, Artificial Sequence
  synthetic Elaeis guineensis (oil palm) single nucleotide polymorphism (SNP) in genomic region adjacent to shatterproof1 (SHELL) shell thickness gene
cggagaaacgtgtctatataaaaawaataataaattaattaaaaaaatta

SEQ ID NO: 3281 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttctttccatttctttatgtatgrtaaaatgatgggaggaggattgaaa

SEQ ID NO: 3282 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagttgggggagttggccaaaaggycagtgggggagggtgcaagctcaga

SEQ ID NO: 3283 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaggatgtttggaagattggggtaygggtgagggccagtgagaagggatt

SEQ ID NO: 3284 - DNA, 50 bp, Artificial Sequence
  synthetic Elaeis guineensis (oil palm) single nucleotide polymorphism (SNP) in genomic region adjacent to shatterproof1 (SHELL) shell thickness gene
atgccaagtatattgaggatgtttrgaagattggggtatgggtgagggcc

SEQ ID NO: 3285 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatgtatcatttggcaatatggtcrcactcgggcccgatcaaatggtaga

SEQ ID NO: 3286 - DNA, 50 bp, Artificial Sequence
  synthetic Elaeis guineensis (oil palm) single nucleotide polymorphism (SNP) in genomic region adjacent to shatterproof1 (SHELL) shell thickness gene
cagccctccaactctgtcgtctatrtatcatttggcaatatggtcacact

SEQ ID NO: 3287 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctgcatgcaatggctcaactctcarccctccaactctgtcgtctatgtat

SEQ ID NO: 3288 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcactatggcttccacctttacagyccgagtgtcgccctctgcatgcaat

SEQ ID NO: 3289 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgccatcttcatacttggataaccwgttcccatccgactctcactatggc

SEQ ID NO: 3290 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggcgtccacatggcaagccaagatyataggccccaccatgccatcttcat

SEQ ID NO: 3291 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagaaaagcatctaagctaggtctrgacaaacccttaattataattttag

SEQ ID NO: 3292 - DNA, 50 bp, Artificial Sequence
  synthetic Elaeis guineensis (oil palm) single nucleotide polymorphism (SNP) in genomic region adjacent to shatterproof1 (SHELL) shell thickness gene
cctatgggaagaaaaaaaacctctrtgagtctttttcttcttcttgcaac

SEQ ID NO: 3293 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcctcgcctccttcctccattaccrtctttattatttcgtctttctgacg

SEQ ID NO: 3294 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagggtcggaccgctcactgactgyggcacgagcgggacggcgccgtcgt

SEQ ID NO: 3295 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggtggtggaagactttcgcggctcygacacatatcgggaggaactcctgg

SEQ ID NO: 3296 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttagagtcgtagagtcgtagacccracatgccatgttaggtcactcggta

SEQ ID NO: 3297 - DNA, 50 bp, Artificial Sequence
  synthetic Elaeis guineensis (oil palm) single nucleotide polymorphism (SNP) in genomic region adjacent to shatterproof1 (SHELL) shell thickness gene
cgaaggttaaagtcgaatgtgcgtygtcccgacatgagttgggcacgttc

SEQ ID NO: 3298 - DNA, 50 bp, Artificial Sequence
  synthetic Elaeis guineensis (oil palm) single nucleotide polymorphism (SNP) in genomic region adjacent to shatterproof1 (SHELL) shell thickness gene
atggcgtccgacacgtttagtcagraaaatgatgacaagtcgagtttcca

SEQ ID NO: 3299 - DNA, 50 bp, Artificial Sequence
  synthetic Elaeis guineensis (oil palm) single nucleotide polymorphism (SNP) in genomic region adjacent to shatterproof1 (SHELL) shell thickness gene
cggggctcgtacttcctggcgagcrccgacccacagtcgaagagtcgaga

SEQ ID NO: 3300 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcgaagagtcgagattccagactcygagattttgaaattgaatttgtatt

SEQ ID NO: 3301 - DNA, 50 bp, Artificial Sequence
  synthetic Elaeis guineensis (oil palm) single nucleotide polymorphism (SNP) in genomic region adjacent to shatterproof1 (SHELL) shell thickness gene
catcttgtagggtccttcccagttyggagctagcttccctcggtctagag

SEQ ID NO: 3302 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccatacgaagttacgcctcgcgtcraagttcggacaagaggtctaagttg

SEQ ID NO: 3303 - DNA, 50 bp, Artificial Sequence
  synthetic Elaeis guineensis (oil palm) single nucleotide polymorphism (SNP) in genomic region adjacent to shatterproof1 (SHELL) shell thickness gene
cgatctccagcgggatcatgacttycgttccgtaggctaagttgaaggga

SEQ ID NO: 3304 - DNA, 50 bp, Artificial Sequence
  synthetic Elaeis guineensis (oil palm) single nucleotide polymorphism (SNP) in genomic region adjacent to shatterproof1 (SHELL) shell thickness gene
acacctccgaaccaattcagccgcrtccttcttcatagtgagccagtagt

SEQ ID NO: 3305 - DNA, 50 bp, Artificial Sequence
  synthetic Elaeis guineensis (oil palm) single nucleotide polymorphism (SNP) in genomic region adjacent to shatterproof1 (SHELL) shell thickness gene
aggatttgccccccaagtgattacygcagatcccttcatgtacttctctg

SEQ ID NO: 3306 - DNA, 50 bp, Artificial Sequence
  synthetic Elaeis guineensis (oil palm) single nucleotide polymorphism (SNP) in genomic region adjacent to shatterproof1 (SHELL) shell thickness gene
caggcacttcagcaagggaagagaraacgatcttttgtatagtcagccat

SEQ ID NO: 3307 - DNA, 50 bp, Artificial Sequence
  synthetic Elaeis guineensis (oil palm) single nucleotide polymorphism (SNP) in genomic region adjacent to shatterproof1 (SHELL) shell thickness gene
gagagaacgatcttttgtatagtcrgccatccaccatcacatattgggaa

SEQ ID NO: 3308 - DNA, 50 bp, Artificial Sequence
  synthetic Elaeis guineensis (oil palm) single nucleotide polymorphism (SNP) in genomic region adjacent to shatterproof1 (SHELL) shell thickness gene
cggatccatccaatttggctctgtygccaattgcagcacctcttcgatct

SEQ ID NO: 3309 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttccagactttttatgaatgtccgrctcaaggtgccgtagtcggatgtcg

SEQ ID NO: 3310 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctttttatgaatgtccgactcaagrtgccgtagtcggatgtcgcgagcct

SEQ ID NO: 3311 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcgcgagcctggagagtacgtcggyccgagcattttccgccctggggatg

SEQ ID NO: 3312 - DNA, 50 bp, Artificial Sequence
  synthetic Elaeis guineensis (oil palm) single nucleotide polymorphism (SNP) in genomic region adjacent to shatterproof1 (SHELL) shell thickness gene
cgccctggggatgtgaaagatctcraagtatttgaagggtgctacgagat

SEQ ID NO: 3313 - DNA, 50 bp, Artificial Sequence
  synthetic Elaeis guineensis (oil palm) single nucleotide polymorphism (SNP) in genomic region adjacent to shatterproof1 (SHELL) shell thickness gene
gacgagcgcctcatattcggcttgrttgttggaggccttgaagtcgaacc

SEQ ID NO: 3314 - DNA, 50 bp, Artificial Sequence
  synthetic Elaeis guineensis (oil palm) single nucleotide polymorphism (SNP) in genomic region adjacent to shatterproof1 (SHELL) shell thickness gene
gttgttggaggccttgaagtcgaaycggagggcgtgctcggtaaccactc

SEQ ID NO: 3315 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttgaaatttatgtgaatacccctcwaaattgatatttgtatatcctcaaa

SEQ ID NO: 3316 - DNA, 50 bp, Artificial Sequence
  synthetic Elaeis guineensis (oil palm) single nucleotide polymorphism (SNP) in genomic region adjacent to shatterproof1 (SHELL) shell thickness gene
catatatacttttataaaatacttrttttgcatgaataaccttttttttt

SEQ ID NO: 3317 - DNA, 50 bp, Artificial Sequence
  synthetic Elaeis guineensis (oil palm) single nucleotide polymorphism (SNP) in genomic region adjacent to shatterproof1 (SHELL) shell thickness gene
gccaattattgctcaaagtgataarctgggcttgttttggtcaagattgg

SEQ ID NO: 3318 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaacatcatggaatttgtggccaaktattgctcaaagtgataagctgggc

SEQ ID NO: 3319 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggaaaggagtgaggagatcaggagraatgcaaggaagtggagggagttgg

SEQ ID NO: 3320 - DNA, 50 bp, Artificial Sequence
  synthetic Elaeis guineensis (oil palm) single nucleotide polymorphism (SNP) in genomic region adjacent to shatterproof1 (SHELL) shell thickness gene
tggagaggtgtgtgagggtggtgayggagggggaaaggagtgaggagatc

SEQ ID NO: 3321 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctaagtatatcgaggatgtgtggasgatcggggtgcgagcgagggccaat

SEQ ID NO: 3322 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgtggcgccgatggttggagtgccrcaatggacggaccaaccgatgaatg

SEQ ID NO: 3323 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccctaagaacttcatagaggatttrtcctcggagcgagggctagtggttt

SEQ ID NO: 3324 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcactctgtattctatctcgtgctktgcctctattcatgttgctggattt

SEQ ID NO: 3325 - DNA, 50 bp, Artificial Sequence
  synthetic Elaeis guineensis (oil palm) single nucleotide polymorphism (SNP) in genomic region adjacent to shatterproof1 (SHELL) shell thickness gene
catttgcctcgcatataaaatcccrgcccaattattggcgaattttcgtc

SEQ ID NO: 3326 - DNA, 50 bp, Artificial Sequence
  synthetic Elaeis guineensis (oil palm) single nucleotide polymorphism (SNP) in genomic region adjacent to shatterproof1 (SHELL) shell thickness gene
taatgaaatgatcatccctcggcayttgcctcgcatataaaatcccggcc

SEQ ID NO: 3327 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcagtaactgaattcagattaccaycatggtcgagccaccttcgataatg

SEQ ID NO: 3328 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttggcaaagattgggacacgtttayttttctttttgtttataacaaattt

SEQ ID NO: 3329 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgtttcctaatttagtgcaattgtytggcaaagattgggacacgtttact

SEQ ID NO: 3330 - DNA, 50 bp, Artificial Sequence
  synthetic Elaeis guineensis (oil palm) single nucleotide polymorphism (SNP) in genomic region adjacent to shatterproof1 (SHELL) shell thickness gene
aattttaattacttccagtgaagtrcaaattctatcttgacctgggaacc

SEQ ID NO: 3331 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgagccttttccatgcatcatattwattttcaaaagttacacgaagcctc

SEQ ID NO: 3332 - DNA, 50 bp, Artificial Sequence
  synthetic Elaeis guineensis (oil palm) single nucleotide polymorphism (SNP) in genomic region adjacent to shatterproof1 (SHELL) shell thickness gene
agcttgagttgttaaggattcaatwtgagagcagagatgagcaggagttt

SEQ ID NO: 3333 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagaaaaaaaaatcttatagcttgrgttgttaaggattcaatatgagagc

SEQ ID NO: 3334 - DNA, 50 bp, Artificial Sequence
  synthetic Elaeis guineensis (oil palm) single nucleotide polymorphism (SNP) in genomic region adjacent to shatterproof1 (SHELL) shell thickness gene
gatccatcatccccctcctatcttyttccatctctctttttctctctttt

SEQ ID NO: 3335 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatgtccacactcccttggctgctyttcaacaatcggatggctctcccaa

SEQ ID NO: 3336 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttggctactggattcatctcactytccccctctctttctctatctgtat

SEQ ID NO: 3337 - DNA, 50 bp, Artificial Sequence
  synthetic Elaeis guineensis (oil palm) single nucleotide polymorphism (SNP) in genomic region adjacent to shatterproof1 (SHELL) shell thickness gene
catcttgcaaggagatggcatgcgrccattcatctttggctactggattc

SEQ ID NO: 3338 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctccccccttacctctctttctcyctctcttactcctctagtctccctc

SEQ ID NO: 3339 - DNA, 50 bp, Artificial Sequence
  synthetic Elaeis guineensis (oil palm) single nucleotide polymorphism (SNP) in genomic region adjacent to shatterproof1 (SHELL) shell thickness gene
cgtgatgactttaattatatacaaytcatcagaagcctttttagagagag

SEQ ID NO: 3340 - DNA, 50 bp, Artificial Sequence
  synthetic Elaeis guineensis (oil palm) single nucleotide polymorphism (SNP) in genomic region adjacent to shatterproof1 (SHELL) shell thickness gene
attgttcatatattattttcagccrtgatgactttaattatatacaactc

SEQ ID NO: 3341 - DNA, 50 bp, Artificial Sequence
  synthetic Elaeis guineensis (oil palm) single nucleotide polymorphism (SNP) in genomic region adjacent to shatterproof1 (SHELL) shell thickness gene
caatagcatataaatatcaacttcytatattttcttcgatggatatttcc

SEQ ID NO: 3342 - DNA, 50 bp, Artificial Sequence
  synthetic Elaeis guineensis (oil palm) single nucleotide polymorphism (SNP) in genomic region adjacent to shatterproof1 (SHELL) shell thickness gene
atcatcagatttacagaagtaaatyaatcaatcagtagattgataaatta

SEQ ID NO: 3343 - DNA, 50 bp, Artificial Sequence
  synthetic Elaeis guineensis (oil palm) single nucleotide polymorphism (SNP) in genomic region adjacent to shatterproof1 (SHELL) shell thickness gene
aggattattaacttctttagcactrgttcaagtgcatatgtcatatctac

SEQ ID NO: 3344 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttgaataattatatctttgccaayaatgatttgagtaggattattaact

SEQ ID NO: 3345 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatagttttatgcactatgccatcmtttatattaaatacaaattttcaaa

SEQ ID NO: 3346 - DNA, 50 bp, Artificial Sequence
  synthetic Elaeis guineensis (oil palm) single nucleotide polymorphism (SNP) in genomic region adjacent to shatterproof1 (SHELL) shell thickness gene
atatatatatattagatttgatttraggcttaaaataattatttttataa

SEQ ID NO: 3347 - DNA, 50 bp, Artificial Sequence
  synthetic Elaeis guineensis (oil palm) single nucleotide polymorphism (SNP) in genomic region adjacent to shatterproof1 (SHELL) shell thickness gene
tccagtgtgtggggtcgccttcctyaaaggagcagcctccacccactttg

SEQ ID NO: 3348 - DNA, 50 bp, Artificial Sequence
  synthetic Elaeis guineensis (oil palm) single nucleotide polymorphism (SNP) in genomic region adjacent to shatterproof1 (SHELL) shell thickness gene
tccgatgggtgctagtatccatgtygacactttggcaccaaactataaac

SEQ ID NO: 3349 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccacatcagagctcccagcctccgrtgggtgctagtatccatgtcgacac

SEQ ID NO: 3350 - DNA, 50 bp, Artificial Sequence
  synthetic Elaeis guineensis (oil palm) single nucleotide polymorphism (SNP) in genomic region adjacent to shatterproof1 (SHELL) shell thickness gene
agctgtggttccacatctcatcagycgaaaaaatatagggagaaaaaaaa

SEQ ID NO: 3351 - DNA, 50 bp, Artificial Sequence
  synthetic Elaeis guineensis (oil palm) single nucleotide polymorphism (SNP) in genomic region adjacent to shatterproof1 (SHELL) shell thickness gene
catcatgcagagaatgtttgggtcyaatgttttgattatagctgtggttc

SEQ ID NO: 3352 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcaccgcatccatcatgcagagaaygtttgggtccaatgttttgattata

SEQ ID NO: 3353 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaatagttcaaaccaaggccatgarctaatacaaatttacccaaacaatg

SEQ ID NO: 3354 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttcatccttataacaaattaattgwatcaatcaaatagttcaaaccaagg

SEQ ID NO: 3355 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcctcacctccatgttcagcaccaycttggattaagctcttgaaacctaa

SEQ ID NO: 3356 - DNA, 50 bp, Artificial Sequence
  synthetic Elaeis guineensis (oil palm) single nucleotide polymorphism (SNP) in genomic region adjacent to shatterproof1 (SHELL) shell thickness gene
acatttgcctctgcctcacctccaygttcagcaccatcttggattaagct

SEQ ID NO: 3357 - DNA, 50 bp, Artificial Sequence
  synthetic Elaeis guineensis (oil palm) single nucleotide polymorphism (SNP) in genomic region adjacent to shatterproof1 (SHELL) shell thickness gene
cacgatcatttgcttcccctgaggyagctccaccacccacatttgcctct

SEQ ID NO: 3358 - DNA, 50 bp, Artificial Sequence
  synthetic Elaeis guineensis (oil palm) single nucleotide polymorphism (SNP) in genomic region adjacent to shatterproof1 (SHELL) shell thickness gene
atggagcacgatcatttgcttcccytgaggtagctccaccacccacattt

SEQ ID NO: 3359 - DNA, 50 bp, Artificial Sequence
  synthetic Elaeis guineensis (oil palm) single nucleotide polymorphism (SNP) in genomic region adjacent to shatterproof1 (SHELL) shell thickness gene
caatcgaaacttaagaaacccttcyagaacatggagcacgatcatttgct

SEQ ID NO: 3360 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctctaatctctctcattgtgctctygtttctcacatatctctaaaaaaaa

SEQ ID NO: 3361 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcagaaaaaagcaattggaaccttrgagacctctctaatctctctcattg

SEQ ID NO: 3362 - DNA, 50 bp, Artificial Sequence
  synthetic Elaeis guineensis (oil palm) single nucleotide polymorphism (SNP) in genomic region adjacent to shatterproof1 (SHELL) shell thickness gene
attttttaaaattaatatttaattwtatttattttctgaagatctgaccc

SEQ ID NO: 3363 - DNA, 50 bp, Artificial Sequence
  synthetic Elaeis guineensis (oil palm) single nucleotide polymorphism (SNP) in genomic region adjacent to shatterproof1 (SHELL) shell thickness gene
tataacctatgtggtgtaatttttkaaaattaatatttaattttatttat

SEQ ID NO: 3364 - DNA, 50 bp, Artificial Sequence
  synthetic Elaeis guineensis (oil palm) single nucleotide polymorphism (SNP) in genomic region adjacent to shatterproof1 (SHELL) shell thickness gene
agttttatcatgcaagagcattaaycatagaagcatattatgcacgcttg

SEQ ID NO: 3365 - DNA, 50 bp, Artificial Sequence
  synthetic Elaeis guineensis (oil palm) single nucleotide polymorphism (SNP) in genomic region adjacent to shatterproof1 (SHELL) shell thickness gene
catatccagtttcaagagtaatctrattttactgagtagactaaattcaa

SEQ ID NO: 3366 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggagcagtgagaaagttgggtgagrttcgttgcatatccagtttcaagag

SEQ ID NO: 3367 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcatacacatgatggagcagtgagraagttgggtgagattcgttgcatat

SEQ ID NO: 3368 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgaattgagttgtgcaatcaaaggyattgggataatcagcttgcatacac

SEQ ID NO: 3369 - DNA, 50 bp, Artificial Sequence
  synthetic Elaeis guineensis (oil palm) single nucleotide polymorphism (SNP) in genomic region adjacent to shatterproof1 (SHELL) shell thickness gene
gatttgtatatgatctttgatgagrtatctacttcttttctttagtgaat

SEQ ID NO: 3370 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcggcaaaagatcgcaagataggcrgtccaggtccaagtcgagggattcg

SEQ ID NO: 3371 - DNA, 50 bp, Artificial Sequence
  synthetic Elaeis guineensis (oil palm) single nucleotide polymorphism (SNP) in genomic region adjacent to shatterproof1 (SHELL) shell thickness gene
gatcacttctatactttttcagaaygagattctcagacgtgagaattgag

SEQ ID NO: 3372 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatcttagcaacttctaaaaggtcytcactgaactccttagtattggtga

SEQ ID NO: 3373 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctcaccaatgctctctttctctgraagtagttctaccagttgtggatga

SEQ ID NO: 3374 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgcttaatgagacttctctgacggygatatgatcgaagctcgagaagatg

SEQ ID NO: 3375 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggagctgaatcgatcaatttgaagrtaaacaggtgaagaaccagcagtaa

SEQ ID NO: 3376 - DNA, 50 bp, Artificial Sequence
  synthetic Elaeis guineensis (oil palm) single nucleotide polymorphism (SNP) in genomic region adjacent to shatterproof1 (SHELL) shell thickness gene
tattttaaatatctatgtacgcatrctagtatcattacttaataaaccat

SEQ ID NO: 3377 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctttgtgtgagaagttctggtattktaaatatctatgtacgcatactagt

SEQ ID NO: 3378 - DNA, 50 bp, Artificial Sequence
  synthetic Elaeis guineensis (oil palm) single nucleotide polymorphism (SNP) in genomic region adjacent to shatterproof1 (SHELL) shell thickness gene
cgataactttttttatgtttcgatratagcatttgtcaccagtgatgttt

SEQ ID NO: 3379 - DNA, 50 bp, Artificial Sequence
  synthetic Elaeis guineensis (oil palm) single nucleotide polymorphism (SNP) in genomic region adjacent to shatterproof1 (SHELL) shell thickness gene
gatcggtaagccaagagtgatggcwatatttataaaaaatcgatcttgta

SEQ ID NO: 3380 - DNA, 50 bp, Artificial Sequence
  synthetic Elaeis guineensis (oil palm) single nucleotide polymorphism (SNP) in genomic region adjacent to shatterproof1 (SHELL) shell thickness gene
aacagtaatatttgttgtttaggasgaaaaagatattaaatgcatgataa

SEQ ID NO: 3381 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctagttcctattcagtctaatttytttagttccatgcaaatcctcttct

SEQ ID NO: 3382 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgagactatgtcagtgaaaactttrtcagttcttgaataaggactctagt

SEQ ID NO: 3383 - DNA, 50 bp, Artificial Sequence
  synthetic Elaeis guineensis (oil palm) single nucleotide polymorphism (SNP) in genomic region adjacent to shatterproof1 (SHELL) shell thickness gene
gctcacttatagctgcctataaccrtctaacaaactcctctaatggccta

SEQ ID NO: 3384 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatttatttctggatcagatcgatwgaatatcgatttgattcaattcaat

SEQ ID NO: 3385 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctctggcacatgataatattagaragaattatttgagaattatattgat

SEQ ID NO: 3386 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatctaaaggtcaaaagttatatgyaagtgacccgacttgcccacttcga

SEQ ID NO: 3387 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaggaaaatctaaaggtcaaaagtyatatgcaagtgacccgacttgccca

SEQ ID NO: 3388 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaagatatgccctcaaagaggaaartctaaaggtcaaaagttatatgcaa

SEQ ID NO: 3389 - DNA, 50 bp, Artificial Sequence
  synthetic Elaeis guineensis (oil palm) single nucleotide polymorphism (SNP) in genomic region adjacent to shatterproof1 (SHELL) shell thickness gene
catttgatgtgaagcacctccatcyatgggctggactttgcaacatcggt

SEQ ID NO: 3390 - DNA, 50 bp, Artificial Sequence
  synthetic Elaeis guineensis (oil palm) single nucleotide polymorphism (SNP) in genomic region adjacent to shatterproof1 (SHELL) shell thickness gene
agatgagatgagacacctgatctcyggattggaccatacaaatacttatt

SEQ ID NO: 3391 - DNA, 50 bp, Artificial Sequence
  synthetic Elaeis guineensis (oil palm) single nucleotide polymorphism (SNP) in genomic region adjacent to shatterproof1 (SHELL) shell thickness gene
agtcaataatactcccaaccaaatyaggataacttgaagtgaggcacctg

SEQ ID NO: 3392 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaagctgatcaaagtcaataatamtcccaaccaaatcaggataacttga

SEQ ID NO: 3393 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccttctttcccatgtaaggcaaaaycatgaggcccaaaatgaccatggcc

SEQ ID NO: 3394 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatgagggaatagctagtttagttycatatcggttgtgagtcaagaggga

SEQ ID NO: 3395 - DNA, 50 bp, Artificial Sequence
  synthetic Elaeis guineensis (oil palm) single nucleotide polymorphism (SNP) in genomic region adjacent to shatterproof1 (SHELL) shell thickness gene
aataattttcaagtcctgtataggwtagttaaacttagatcgggctatga

SEQ ID NO: 3396 - DNA, 50 bp, Artificial Sequence
  synthetic Elaeis guineensis (oil palm) single nucleotide polymorphism (SNP) in genomic region adjacent to shatterproof1 (SHELL) shell thickness gene
tacacattggatttattagtatcgrtttgttcttaattaaccaatctaat

SEQ ID NO: 3397 - DNA, 50 bp, Artificial Sequence
  synthetic Elaeis guineensis (oil palm) single nucleotide polymorphism (SNP) in genomic region adjacent to shatterproof1 (SHELL) shell thickness gene
atatttcttaaaatgtctatcatayacattggatttattagtatcgattt

SEQ ID NO: 3398 - DNA, 50 bp, Artificial Sequence
  synthetic Elaeis guineensis (oil palm) single nucleotide polymorphism (SNP) in genomic region adjacent to shatterproof1 (SHELL) shell thickness gene
atcggacagagatatttcttaaaaygtctatcatacacattggatttatt

SEQ ID NO: 3399 - DNA, 50 bp, Artificial Sequence
  synthetic Elaeis guineensis (oil palm) single nucleotide polymorphism (SNP) in genomic region adjacent to shatterproof1 (SHELL) shell thickness gene
gagaaaatcatctgatatatggggratccaatctatccacgacgacatcg

SEQ ID NO: 3400 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttcaaggttgacctcataaggcatyaacttgacaagttttggctcaaatt

SEQ ID NO: 3401 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggacctgagttctgattaagactayaacgtattcaaggttgacctcataa

SEQ ID NO: 3402 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttcaatatagccatcaaccagttyatcaagatgaacaccacattgatga

SEQ ID NO: 3403 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcagaagcagtttcacctccacttyaatataccacagagtagcaattaga

SEQ ID NO: 3404 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctccatctgatttttgacttatttkatagatttttttgaagcatttcaaa

SEQ ID NO: 3405 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcatcgaagggttaagaactggagratctccatctgatttttgacttatt

SEQ ID NO: 3406 - DNA, 50 bp, Artificial Sequence
  synthetic Elaeis guineensis (oil palm) single nucleotide polymorphism (SNP) in genomic region adjacent to shatterproof1 (SHELL) shell thickness gene
taaaaatagaaaatcagggatcctycaatagttagtttaaaatcctaatt

SEQ ID NO: 3407 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctaacggtctaacaagttctgtaayggcctcatcaatccttctataaaaa

SEQ ID NO: 3408 - DNA, 50 bp, Artificial Sequence
  synthetic Elaeis guineensis (oil palm) single nucleotide polymorphism (SNP) in genomic region adjacent to shatterproof1 (SHELL) shell thickness gene
agttcacttacagctggctataacygcataacaaactcttctaacggtct

SEQ ID NO: 3409 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatgttacaacttatctctaactgrcacgtacagttaagtatgatctcac

SEQ ID NO: 3410 - DNA, 50 bp, Artificial Sequence
  synthetic Elaeis guineensis (oil palm) single nucleotide polymorphism (SNP) in genomic region adjacent to shatterproof1 (SHELL) shell thickness gene
agaattatattgatcaaaatctacytctggatcagatcggttgaataccg

SEQ ID NO: 3411 - DNA, 50 bp, Artificial Sequence
  synthetic Elaeis guineensis (oil palm) single nucleotide polymorphism (SNP) in genomic region adjacent to shatterproof1 (SHELL) shell thickness gene
cccatctctggcacgtggcaatatyagagagaatcatctgagaattatat

SEQ ID NO: 3412 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggatgagggtaacgagattaaatayatagtaactgttgtaagggttatac

SEQ ID NO: 3413 - DNA, 50 bp, Artificial Sequence
  synthetic Elaeis guineensis (oil palm) single nucleotide polymorphism (SNP) in genomic region adjacent to shatterproof1 (SHELL) shell thickness gene
aattagataatttggtacttaggaygagggtaacgagattaaatatatag

SEQ ID NO: 3414 - DNA, 50 bp, Artificial Sequence
  synthetic Elaeis guineensis (oil palm) single nucleotide polymorphism (SNP) in genomic region adjacent to shatterproof1 (SHELL) shell thickness gene
taatatttttttatataggcagctytgatgttatggatacggaaatgaaa

SEQ ID NO: 3415 - DNA, 50 bp, Artificial Sequence
  synthetic Elaeis guineensis (oil palm) single nucleotide polymorphism (SNP) in genomic region adjacent to shatterproof1 (SHELL) shell thickness gene
acccgtggtcaagtgattttttttwaaaattcccttaatatttttttata

SEQ ID NO: 3416 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcttcgacttacaacacagccccarcatcaatctctgcatgcaatggctc

SEQ ID NO: 3417 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcagactctcactacggcttcgacytacaacacagccccagcatcaatct

SEQ ID NO: 3418 - DNA, 50 bp, Artificial Sequence
  synthetic Elaeis guineensis (oil palm) single nucleotide polymorphism (SNP) in genomic region adjacent to shatterproof1 (SHELL) shell thickness gene
catatggcgagccaagatcataggycctatggtgccatcctcatacttgg

SEQ ID NO: 3419 - DNA, 50 bp, Artificial Sequence
  synthetic Elaeis guineensis (oil palm) single nucleotide polymorphism (SNP) in genomic region adjacent to shatterproof1 (SHELL) shell thickness gene
atggatttctattctattatagccyagctttgcagcaattgaggattttt

SEQ ID NO: 3420 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaacgtgttcttagataatttaagytagctaggtcaataggcccaattct

SEQ ID NO: 3421 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggtcttgtatcaaccaaaatacaakctagtttaaatcctagaaggaaaaa

SEQ ID NO: 3422 - DNA, 50 bp, Artificial Sequence
  synthetic Elaeis guineensis (oil palm) single nucleotide polymorphism (SNP) in genomic region adjacent to shatterproof1 (SHELL) shell thickness gene
agtgtggtcttgtatcaaccaaaakacaagctagtttaaatcctagaagg

SEQ ID NO: 3423 - DNA, 50 bp, Artificial Sequence
  synthetic Elaeis guineensis (oil palm) single nucleotide polymorphism (SNP) in genomic region adjacent to shatterproof1 (SHELL) shell thickness gene
tactactagaggaccggtgcctcgyaaggatgaagaagagttccgcttga

SEQ ID NO: 3424 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaagtttgttggataatgagtgcgrgttaactaggtacatccttaactac

SEQ ID NO: 3425 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatagcagagatagagtaaaagttygttggataatgagtgcgagttaact

SEQ ID NO: 3426 - DNA, 50 bp, Artificial Sequence
  synthetic Elaeis guineensis (oil palm) single nucleotide polymorphism (SNP) in genomic region adjacent to shatterproof1 (SHELL) shell thickness gene
taaaactttgttggataatgagtgygaaaaacttatgacttaggttgtta

SEQ ID NO: 3427 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgtgttagagcagagatgagtaaarctttgttggataatgagtgcgaaaa

SEQ ID NO: 3428 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctactttttgtttttaaatgtggaktagccaatgtatttgaaaatcttat

SEQ ID NO: 3429 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttggactacggttcatgtgggtcytggatcttcatgcgatccgagatga

SEQ ID NO: 3430 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatttaatttctttgagtaggttaktaaaggatttggactacggttcatg

SEQ ID NO: 3431 - DNA, 50 bp, Artificial Sequence
  synthetic Elaeis guineensis (oil palm) single nucleotide polymorphism (SNP) in genomic region adjacent to shatterproof1 (SHELL) shell thickness gene
actataaaattattaaatattataraattataaaaattaatattttgaga

SEQ ID NO: 3432 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtccacattgtgacctattgaaagraattctagatttcattttaatacgt

SEQ ID NO: 3433 - DNA, 50 bp, Artificial Sequence
  synthetic Elaeis guineensis (oil palm) single nucleotide polymorphism (SNP) in genomic region adjacent to shatterproof1 (SHELL) shell thickness gene
taattattttttttaagatcgatartatttgtgttcaataggtttttgga

SEQ ID NO: 3434 - DNA, 50 bp, Artificial Sequence
  synthetic Elaeis guineensis (oil palm) single nucleotide polymorphism (SNP) in genomic region adjacent to shatterproof1 (SHELL) shell thickness gene
caaatcttaattgtttgcagtcggrtacgatgaagtgaatgacagtattt

SEQ ID NO: 3435 - DNA, 50 bp, Artificial Sequence
  synthetic Elaeis guineensis (oil palm) single nucleotide polymorphism (SNP) in genomic region adjacent to shatterproof1 (SHELL) shell thickness gene
gataatgttttcaattggagatcgrccattaggctattttataacaaatt

SEQ ID NO: 3436 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaattaagctattagacgacctcygtatgataatgttttcaattggaga

SEQ ID NO: 3437 - DNA, 50 bp, Artificial Sequence
  synthetic Elaeis guineensis (oil palm) single nucleotide polymorphism (SNP) in genomic region adjacent to shatterproof1 (SHELL) shell thickness gene
aattagtgggaaggatagacatgarattttcaaaaattaagctattagac

SEQ ID NO: 3438 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttttctttcctttcaaatttcatcraaacaaaagtcccaagcaaaattag

SEQ ID NO: 3439 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcgtacagaataaagtcattcatcyatagatacaaatctcaaagtactac

SEQ ID NO: 3440 - DNA, 50 bp, Artificial Sequence
  synthetic Elaeis guineensis (oil palm) single nucleotide polymorphism (SNP) in genomic region adjacent to shatterproof1 (SHELL) shell thickness gene
atctatccatttatatagatcgtamagaataaagtcattcatctatagat

SEQ ID NO: 3441 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatcctctatcattcatcaatttgwatgaaatttaaaatattatattttc

SEQ ID NO: 3442 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatattctattctctatcatctatytatttacatacatcttaaatcactc

SEQ ID NO: 3443 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttgaagtacttcatcctttgtcayccatctcaaaatattctattctcta

SEQ ID NO: 3444 - DNA, 50 bp, Artificial Sequence
  synthetic Elaeis guineensis (oil palm) single nucleotide polymorphism (SNP) in genomic region adjacent to shatterproof1 (SHELL) shell thickness gene
cattgatctatctacacagattttraagtacttcatcctttgtcacccat

SEQ ID NO: 3445 - DNA, 50 bp, Artificial Sequence
  synthetic Elaeis guineensis (oil palm) single nucleotide polymorphism (SNP) in genomic region adjacent to shatterproof1 (SHELL) shell thickness gene
atcgatttgcatgaatgttgatgcrttccatcttctatcattgatctatc

SEQ ID NO: 3446 - DNA, 50 bp, Artificial Sequence
  synthetic Elaeis guineensis (oil palm) single nucleotide polymorphism (SNP) in genomic region adjacent to shatterproof1 (SHELL) shell thickness gene
atttgtctatacagatcttaaaatrcttcatttataatttatttatctat

SEQ ID NO: 3447 - DNA, 50 bp, Artificial Sequence
  synthetic Elaeis guineensis (oil palm) single nucleotide polymorphism (SNP) in genomic region adjacent to shatterproof1 (SHELL) shell thickness gene
cattcatttacctacatatatcgckaagcattttgtctgtaatccatttg

SEQ ID NO: 3448 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcgagcatagatcgtgaagtgctcyagcttcaaccatccatccgcatata

SEQ ID NO: 3449 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatcttaaaatactgcatcctttaycattcatttgcgagcatagatcgtg

SEQ ID NO: 3450 - DNA, 50 bp, Artificial Sequence
  synthetic Elaeis guineensis (oil palm) single nucleotide polymorphism (SNP) in genomic region adjacent to shatterproof1 (SHELL) shell thickness gene
atttacataaatcttaaaatactgyatcctttatcattcatttgcgagca

SEQ ID NO: 3451 - DNA, 50 bp, Artificial Sequence
  synthetic Elaeis guineensis (oil palm) single nucleotide polymorphism (SNP) in genomic region adjacent to shatterproof1 (SHELL) shell thickness gene
actcatttaactattcaatccattstccttcgtatgttctttacttgtat

SEQ ID NO: 3452 - DNA, 50 bp, Artificial Sequence
  synthetic Elaeis guineensis (oil palm) single nucleotide polymorphism (SNP) in genomic region adjacent to shatterproof1 (SHELL) shell thickness gene
atggcatgaggactgttccatgctygtttgtttatttttattccttgaat

SEQ ID NO: 3453 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggtcggctgtttcctgacgcactgyggatggaattcaactatggagggga

SEQ ID NO: 3454 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttgggtggtgagatcctcggaaacytctaagctcccagagaacttcatga

SEQ ID NO: 3455 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatgcttggccccgaccaaatggckgagcttgcattcggtcttctcaata

SEQ ID NO: 3456 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccgcaaaattaattctattttttawatttttagttttgaaattagaaaga

SEQ ID NO: 3457 - DNA, 50 bp, Artificial Sequence
  synthetic Elaeis guineensis (oil palm) single nucleotide polymorphism (SNP) in genomic region adjacent to shatterproof1 (SHELL) shell thickness gene
agctacaatattaaaacttaagatrtagccgcaaaattaattctattttt

SEQ ID NO: 3458 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatttttagtttcattaattcttcytatcatccacgattgcaattagcaa

SEQ ID NO: 3459 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctctctttgccataattccatttrttacccactaaaagacttagtttga

SEQ ID NO: 3460 - DNA, 50 bp, Artificial Sequence
  synthetic Elaeis guineensis (oil palm) single nucleotide polymorphism (SNP) in genomic region adjacent to shatterproof1 (SHELL) shell thickness gene
acagcttggaatattttgtacttgwctctctttgccataattccatttat

SEQ ID NO: 3461 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttgtgacagcttggaatattttgtwcttgtctctctttgccataattcca

SEQ ID NO: 3462 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgtttctgactaggaatagtcataycttcacccaacaatattctatatct

SEQ ID NO: 3463 - DNA, 50 bp, Artificial Sequence
  synthetic Elaeis guineensis (oil palm) single nucleotide polymorphism (SNP) in genomic region adjacent to shatterproof1 (SHELL) shell thickness gene
acttagatctcaatgtgagatgtarttctagcaatgatttgataagcatt

SEQ ID NO: 3464 - DNA, 50 bp, Artificial Sequence
  synthetic Elaeis guineensis (oil palm) single nucleotide polymorphism (SNP) in genomic region adjacent to shatterproof1 (SHELL) shell thickness gene
catgcccctctccctgagaagtgtytgagtaaagagacagtcctaggcaa

SEQ ID NO: 3465 - DNA, 50 bp, Artificial Sequence
  synthetic Elaeis guineensis (oil palm) single nucleotide polymorphism (SNP) in genomic region adjacent to shatterproof1 (SHELL) shell thickness gene
cggatgagcgacaactctccaaatytaggcagcctcaatccgtctagaga

SEQ ID NO: 3466 - DNA, 50 bp, Artificial Sequence
  synthetic Elaeis guineensis (oil palm) single nucleotide polymorphism (SNP) in genomic region adjacent to shatterproof1 (SHELL) shell thickness gene
gttgagtgatcttttatactctcarctgaaagtatcaacagcaatgagat

SEQ ID NO: 3467 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggccaatgagataaaggaatgctcraaatccaagcatcctggatcacccc

SEQ ID NO: 3468 - DNA, 50 bp, Artificial Sequence
  synthetic Elaeis guineensis (oil palm) single nucleotide polymorphism (SNP) in genomic region adjacent to shatterproof1 (SHELL) shell thickness gene
caagaaattgcgaaactgctgctcyagccttctgacacaagccacgggga

SEQ ID NO: 3469 - DNA, 50 bp, Artificial Sequence
  synthetic Elaeis guineensis (oil palm) single nucleotide polymorphism (SNP) in genomic region adjacent to shatterproof1 (SHELL) shell thickness gene
acgcacctcgttattcaaaatcctrttctcctacgcagtaatacagacca

SEQ ID NO: 3470 - DNA, 50 bp, Artificial Sequence
  synthetic Elaeis guineensis (oil palm) single nucleotide polymorphism (SNP) in genomic region adjacent to shatterproof1 (SHELL) shell thickness gene
caaatttttgataaaaatttaatgwttcaccacctccctcttattcattt

SEQ ID NO: 3471 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtaccactttgcccaaaaaatacasaggaagatggactatacagatgtat

SEQ ID NO: 3472 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctcatcccttctcacaatcccackctcatctactcttgctcgcactccc

SEQ ID NO: 3473 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgaagctaaagttatggtcttcagrtcctttttagttgctactctagcta

SEQ ID NO: 3474 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttctgatgacaagcagcttccaacragtcatcataaacttcatgttacat

SEQ ID NO: 3475 - DNA, 50 bp, Artificial Sequence
  synthetic Elaeis guineensis (oil palm) single nucleotide polymorphism (SNP) in genomic region adjacent to shatterproof1 (SHELL) shell thickness gene
gagcttgcagaaatgcccttttctratgacaagcagcttccaacaagtca

SEQ ID NO: 3476 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctcaagatgactcatcctgctgaytgttagaaaactacgcaatgttaag

SEQ ID NO: 3477 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaatgctaatattgaaggtgttcrcatcacactaagcaccgatcatgca

SEQ ID NO: 3478 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaggtgctgaaagacattcattatrttcttcttcttcttcttcttattct

SEQ ID NO: 3479 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctccagttctacaagaaacaatctstgcttatccttgtcctttcttcttt

SEQ ID NO: 3480 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgaggttctccagttctacaagaawcaatctgtgcttatccttgtccttt

SEQ ID NO: 3481 - DNA, 50 bp, Artificial Sequence
  synthetic Elaeis guineensis (oil palm) single nucleotide polymorphism (SNP) in genomic region adjacent to shatterproof1 (SHELL) shell thickness gene
gggaaatatcataatgccagacccrgaacatagtatagcagaattagcac

SEQ ID NO: 3482 - DNA, 50 bp, Artificial Sequence
  synthetic Elaeis guineensis (oil palm) single nucleotide polymorphism (SNP) in genomic region adjacent to shatterproof1 (SHELL) shell thickness gene
catctttttggtcagggaaggtctkgtacttcgctcataccttattcaaa

SEQ ID NO: 3483 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttacatctttttggtcagggaagrtctggtacttcgctcataccttatt

SEQ ID NO: 3484 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggggtttatggtgcaatccaagttrcagcaagagagagcctttctctgat

SEQ ID NO: 3485 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgaaggggtttatggtgcaatccargttacagcaagagagagcctttctc

SEQ ID NO: 3486 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttcataggctcattgccaaggctcyagagatgtgaaggggtttatggtgc

SEQ ID NO: 3487 - DNA, 50 bp, Artificial Sequence
  synthetic Elaeis guineensis (oil palm) single nucleotide polymorphism (SNP) in genomic region adjacent to shatterproof1 (SHELL) shell thickness gene
tggcggatgcgttgtcattaacgaygctaaaaagcgccgttaaaagttaa

SEQ ID NO: 3488 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaactgtcaacgccgacgcttttakcaaaagcgtcgttaaataaagaaaa

SEQ ID NO: 3489 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgcatggctgttggctaccaaagcyattgagaaaagccaaacgtctgaac

SEQ ID NO: 3490 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttgctaaactgatgcgtttttcttrgggggtttataaagcgatcgaaaga

SEQ ID NO: 3491 - DNA, 50 bp, Artificial Sequence
  synthetic Elaeis guineensis (oil palm) single nucleotide polymorphism (SNP) in genomic region adjacent to shatterproof1 (SHELL) shell thickness gene
aattaaatagtcaatttgattgtargtagctcaaatacttgaagatgttg

SEQ ID NO: 3492 - DNA, 50 bp, Artificial Sequence
  synthetic Elaeis guineensis (oil palm) single nucleotide polymorphism (SNP) in genomic region adjacent to shatterproof1 (SHELL) shell thickness gene
atgctcagaatgtcctctaccttgrctccaaggcacatttaaccttcaaa

SEQ ID NO: 3493 - DNA, 50 bp, Artificial Sequence
  synthetic Elaeis guineensis (oil palm) single nucleotide polymorphism (SNP) in genomic region adjacent to shatterproof1 (SHELL) shell thickness gene
attgaactagagagatctgatacawaatcactagccctctgtgtcttgca

SEQ ID NO: 3494 - DNA, 50 bp, Artificial Sequence
  synthetic Elaeis guineensis (oil palm) single nucleotide polymorphism (SNP) in genomic region adjacent to shatterproof1 (SHELL) shell thickness gene
cattgaggtcatctggaaattgacsaccacttttgatagatgagagttgg

SEQ ID NO: 3495 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttacttgcaaacagggacatggcakggaggtatcatctaaagagcaatta

SEQ ID NO: 3496 - DNA, 50 bp, Artificial Sequence
  synthetic Elaeis guineensis (oil palm) single nucleotide polymorphism (SNP) in genomic region adjacent to shatterproof1 (SHELL) shell thickness gene
caattacttgcaaacagggacatgrcatggaggtatcatctaaagagcaa

SEQ ID NO: 3497 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttctaatacagaaaagatagtgtgscatcaatccagtacaaatatcaggt

SEQ ID NO: 3498 - DNA, 50 bp, Artificial Sequence
  synthetic Elaeis guineensis (oil palm) single nucleotide polymorphism (SNP) in genomic region adjacent to shatterproof1 (SHELL) shell thickness gene
atataaatcaatgaaatttaacgaygaaaatttgcttagaataaaccaat

SEQ ID NO: 3499 - DNA, 50 bp, Artificial Sequence
  synthetic Elaeis guineensis (oil palm) single nucleotide polymorphism (SNP) in genomic region adjacent to shatterproof1 (SHELL) shell thickness gene
taagaaattaagaatataaatcaaygaaatttaacgatgaaaatttgctt

SEQ ID NO: 3500 - DNA, 50 bp, Artificial Sequence
  synthetic Elaeis guineensis (oil palm) single nucleotide polymorphism (SNP) in genomic region adjacent to shatterproof1 (SHELL) shell thickness gene
cacttgttatcatctaagcttgatrctttacaagtctacattttgccttc

SEQ ID NO: 3501 - DNA, 50 bp, Artificial Sequence
  synthetic Elaeis guineensis (oil palm) single nucleotide polymorphism (SNP) in genomic region adjacent to shatterproof1 (SHELL) shell thickness gene
gatcataatttagcaaaatcagtgytgtattatactgatgtttttccctc

SEQ ID NO: 3502 - DNA, 50 bp, Artificial Sequence
  synthetic Elaeis guineensis (oil palm) single nucleotide polymorphism (SNP) in genomic region adjacent to shatterproof1 (SHELL) shell thickness gene
catcccaccatacgtgtgggccccyaatgaaaccaagccccacgctagtg

SEQ ID NO: 3503 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtgcccaccgcatcccaccatacgygtgggcccccaatgaaaccaagccc

SEQ ID NO: 3504 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtccgggatctgcctgcgagagaakgacacaagctgtgcccaccgcatcc

SEQ ID NO: 3505 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaggcatggacaacggactcatttrtttgttatggttgtgcaatttgtta

SEQ ID NO: 3506 - DNA, 50 bp, Artificial Sequence
  synthetic Elaeis guineensis (oil palm) single nucleotide polymorphism (SNP) in genomic region adjacent to shatterproof1 (SHELL) shell thickness gene
acggactcatttatttgttatggtkgtgcaatttgttatggtgataaaaa

SEQ ID NO: 3507 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagaaatttgttcttcacttgcttstcatgtcacacacattttcagtccc

SEQ ID NO: 3508 - DNA, 50 bp, Artificial Sequence
  synthetic Elaeis guineensis (oil palm) single nucleotide polymorphism (SNP) in genomic region adjacent to shatterproof1 (SHELL) shell thickness gene
atcctaaatttgcatatctgcatckatggacacatgttaagaggcaataa

SEQ ID NO: 3509 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctatcccttattcctcgttctaatytttattgttgtacatgtagtcattg

SEQ ID NO: 3510 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccgccatttctcagtttgcaagacycgtgtcccaggtggttgtgcacatt

SEQ ID NO: 3511 - DNA, 50 bp, Artificial Sequence
  synthetic Elaeis guineensis (oil palm) single nucleotide polymorphism (SNP) in genomic region adjacent to shatterproof1 (SHELL) shell thickness gene
caagaaggaagaactgaaatggaasctgttggtcagcaaagtgatggcag

SEQ ID NO: 3512 - DNA, 50 bp, Artificial Sequence
  synthetic Elaeis guineensis (oil palm) single nucleotide polymorphism (SNP) in genomic region adjacent to shatterproof1 (SHELL) shell thickness gene
taggttgccaaagcttgttgcaccrtgacggtgccaccgtatgtaaagaa

SEQ ID NO: 3513 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgtattctggtgactgtaacaatawggtggaattgaacaaaattttgtat

SEQ ID NO: 3514 - DNA, 50 bp, Artificial Sequence
  synthetic Elaeis guineensis (oil palm) single nucleotide polymorphism (SNP) in genomic region adjacent to shatterproof1 (SHELL) shell thickness gene
agcttgaggattgagttgggagagmacagattagggttatcacgaccatg

SEQ ID NO: 3515 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggagagaacagattagggttatcaygaccatggttatgaatcgcttttgt

SEQ ID NO: 3516 - DNA, 50 bp, Artificial Sequence
  synthetic Elaeis guineensis (oil palm) single nucleotide polymorphism (SNP) in genomic region adjacent to shatterproof1 (SHELL) shell thickness gene
gagaacagattagggttatcacgascatggttatgaatcgcttttgtgct

SEQ ID NO: 3517 - DNA, 50 bp, Artificial Sequence
  synthetic Elaeis guineensis (oil palm) single nucleotide polymorphism (SNP) in genomic region adjacent to shatterproof1 (SHELL) shell thickness gene
acaggtaaccccagagaatatcaaytggtgagcaaaaatgaggtaacaac

SEQ ID NO: 3518 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgctactctgcattttgagtttctwcaattggctcaaatttactgtctgg

SEQ ID NO: 3519 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttgttctttctctcttttttttttwttttggctcccatcctctcgttttc

SEQ ID NO: 3520 - DNA, 50 bp, Artificial Sequence
  synthetic Elaeis guineensis (oil palm) single nucleotide polymorphism (SNP) in genomic region adjacent to shatterproof1 (SHELL) shell thickness gene
gctcccatcctctcgttttcagagmagaaaatacgagtcttaaatcactc

SEQ ID NO: 3521 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaatacgagtcttaaatcactccytgacgcactgttctaatctcattta

SEQ ID NO: 3522 - DNA, 50 bp, Artificial Sequence
  synthetic Elaeis guineensis (oil palm) single nucleotide polymorphism (SNP) in genomic region adjacent to shatterproof1 (SHELL) shell thickness gene
cttggtgtcatcattttgtctttcytcctttcatctgatggttcccagct

SEQ ID NO: 3523 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggttcccagctatgccatccagagwctcactccctgttcgtactccattt

SEQ ID NO: 3524 - DNA, 50 bp, Artificial Sequence
  synthetic Elaeis guineensis (oil palm) single nucleotide polymorphism (SNP) in genomic region adjacent to shatterproof1 (SHELL) shell thickness gene
catccagagactcactccctgttcktactccatttaactcacccggcgtt

SEQ ID NO: 3525 - DNA, 50 bp, Artificial Sequence
  synthetic Elaeis guineensis (oil palm) single nucleotide polymorphism (SNP) in genomic region adjacent to shatterproof1 (SHELL) shell thickness gene
aattttctccatatttaatattatrtaaattttttcttttccatctatcc

SEQ ID NO: 3526 - DNA, 50 bp, Artificial Sequence
  synthetic Elaeis guineensis (oil palm) single nucleotide polymorphism (SNP) in genomic region adjacent to shatterproof1 (SHELL) shell thickness gene
cacatcctccctctccctccgattkaggccatgaactaataactgaccag

SEQ ID NO: 3527 - DNA, 50 bp, Artificial Sequence
  synthetic Elaeis guineensis (oil palm) single nucleotide polymorphism (SNP) in genomic region adjacent to shatterproof1 (SHELL) shell thickness gene
agttccttgttctctctaattttgyttgtcctagttttaggatctttttg

SEQ ID NO: 3528 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgtggaatgagatagagatcctttwttaattttttaattgatattctttg

SEQ ID NO: 3529 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttcaattaaatttgaaaggttgctrttttattgtgcttctgctatgtgca

SEQ ID NO: 3530 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatcagcaaatatgctttatgctayggtacctagactctctatttttaag

SEQ ID NO: 3531 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttaacatatcttttttcccagtggratgtaggggaactcttagttttaag

SEQ ID NO: 3532 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttaagtgctggataccttcaattwgaatataaagttttcaaggttttgt

SEQ ID NO: 3533 - DNA, 50 bp, Artificial Sequence
  synthetic Elaeis guineensis (oil palm) single nucleotide polymorphism (SNP) in genomic region adjacent to shatterproof1 (SHELL) shell thickness gene
catatatatatatatgtctatacaygtgtatatatgcatacataaatgca

SEQ ID NO: 3534 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttaccgtaccatatggtgtaccgayatcgtaacaggatggtactgagaca

SEQ ID NO: 3535 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccgtaccatatggtgtaccgacatygtaacaggatggtactgagacagtg

SEQ ID NO: 3536 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttattctaaacgtgaaaaactatcstgcaagcacaaactgaataaccaaa

SEQ ID NO: 3537 - DNA, 50 bp, Artificial Sequence
  synthetic Elaeis guineensis (oil palm) single nucleotide polymorphism (SNP) in genomic region adjacent to shatterproof1 (SHELL) shell thickness gene
atagaaggatggacggaaatgattycctcctttgtttggtataggaaaaa

SEQ ID NO: 3538 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctatccttccaatttcatccatamattttctaatgactccaacaaaaca

SEQ ID NO: 3539 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttctaatgactccaacaaaacatarggtaattttcaccgtaagaaacgaa

SEQ ID NO: 3540 - DNA, 50 bp, Artificial Sequence
  synthetic Elaeis guineensis (oil palm) single nucleotide polymorphism (SNP) in genomic region adjacent to shatterproof1 (SHELL) shell thickness gene
acattgttgatttaaactaaagctraagataatatttttaaaggggaact

SEQ ID NO: 3541 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttttaaagtaattagtgacttctmcaaaatagaagcccattaactaaaa

SEQ ID NO: 3542 - DNA, 50 bp, Artificial Sequence
  synthetic Elaeis guineensis (oil palm) single nucleotide polymorphism (SNP) in genomic region adjacent to shatterproof1 (SHELL) shell thickness gene
atgatcaaatctgtttctgtatctrgttcggatcagatttgaatagagat

SEQ ID NO: 3543 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttggatttgaatatagatattaagrtttttttggatccagatgcagatag

SEQ ID NO: 3544 - DNA, 50 bp, Artificial Sequence
  synthetic Elaeis guineensis (oil palm) single nucleotide polymorphism (SNP) in genomic region adjacent to shatterproof1 (SHELL) shell thickness gene
cctcttaggagcctccaactgtcayggatgagagggtgttgagccgctcc

SEQ ID NO: 3545 - DNA, 50 bp, Artificial Sequence
  synthetic Elaeis guineensis (oil palm) single nucleotide polymorphism (SNP) in genomic region adjacent to shatterproof1 (SHELL) shell thickness gene
tagaattctcctcaatcatcaatcrattggcccttaggaccccttgcatg

SEQ ID NO: 3546 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtcgaagttgacctttagaaatctrggggatgggggctcccaagtgagaa

SEQ ID NO: 3547 - DNA, 50 bp, Artificial Sequence
  synthetic Elaeis guineensis (oil palm) single nucleotide polymorphism (SNP) in genomic region adjacent to shatterproof1 (SHELL) shell thickness gene
gctcccaagtgagaaaactcatcgrgacactacatgagcgtgaggggggt

SEQ ID NO: 3548 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcaccctaggaagaatagtggacarccgctagatgtgcgtagctctcaaa

SEQ ID NO: 3549 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggtatgcatgaagaccaccatatcytggtgccagggccactgtggacagg

SEQ ID NO: 3550 - DNA, 50 bp, Artificial Sequence
  synthetic Elaeis guineensis (oil palm) single nucleotide polymorphism (SNP) in genomic region adjacent to shatterproof1 (SHELL) shell thickness gene
acaaaggtcagacaccagcacagcrgaaggtcaactactcacgagtctcg

SEQ ID NO: 3551 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgatcgagagcccatcccccacccrccaagaagtcagggccaacacctca

SEQ ID NO: 3552 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtagtttaggattcatatttggcaygcatcatcgtactccaggggttgct

SEQ ID NO: 3553 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgccaagcgatcagagccttgtgcygaaccactaggatctttatgcctag

SEQ ID NO: 3554 - DNA, 50 bp, Artificial Sequence
  synthetic Elaeis guineensis (oil palm) single nucleotide polymorphism (SNP) in genomic region adjacent to shatterproof1 (SHELL) shell thickness gene
attgatcggctgacaaataaccttycatgctagaagatgtaccccatttc

SEQ ID NO: 3555 - DNA, 50 bp, Artificial Sequence
  synthetic Elaeis guineensis (oil palm) single nucleotide polymorphism (SNP) in genomic region adjacent to shatterproof1 (SHELL) shell thickness gene
accccatttcctccatggtgcgaaycacataggaagttcttgaagagttg

SEQ ID NO: 3556 - DNA, 50 bp, Artificial Sequence
  synthetic Elaeis guineensis (oil palm) single nucleotide polymorphism (SNP) in genomic region adjacent to shatterproof1 (SHELL) shell thickness gene
atattttaaaaatctttttatttawaatattcaaaaataccaataatgtc

SEQ ID NO: 3557 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttaaaatattcaaaaataccaatratgtcaatatattcctaatttgtat

SEQ ID NO: 3558 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttatttaaaaatagatgattcatrattctttttatttatgctgcaatta

SEQ ID NO: 3559 - DNA, 50 bp, Artificial Sequence
  synthetic Elaeis guineensis (oil palm) single nucleotide polymorphism (SNP) in genomic region adjacent to shatterproof1 (SHELL) shell thickness gene
tggatataactaataccggacttgwatccatatttgtattcattaaaaaa

SEQ ID NO: 3560 - DNA, 50 bp, Artificial Sequence
  synthetic Elaeis guineensis (oil palm) single nucleotide polymorphism (SNP) in genomic region adjacent to shatterproof1 (SHELL) shell thickness gene
tggaaccaaggttttaaatctcttrggacgagactgttccgattttttca

SEQ ID NO: 3561 - DNA, 50 bp, Artificial Sequence
  synthetic Elaeis guineensis (oil palm) single nucleotide polymorphism (SNP) in genomic region adjacent to shatterproof1 (SHELL) shell thickness gene
taggacgagactgttccgatttttycatggaatgggatgcgccgccgtcc

SEQ ID NO: 3562 - DNA, 50 bp, Artificial Sequence
  synthetic Elaeis guineensis (oil palm) single nucleotide polymorphism (SNP) in genomic region adjacent to shatterproof1 (SHELL) shell thickness gene
atgggatgcgccgccgtcccgtccygtcctgatacttggaatagaggatg

SEQ ID NO: 3563 - DNA, 50 bp, Artificial Sequence
  synthetic Elaeis guineensis (oil palm) single nucleotide polymorphism (SNP) in genomic region adjacent to shatterproof1 (SHELL) shell thickness gene
gatatcccaatcgggacattgggaygctagtgggacactgtatcccaaca

SEQ ID NO: 3564 - DNA, 50 bp, Artificial Sequence
  synthetic Elaeis guineensis (oil palm) single nucleotide polymorphism (SNP) in genomic region adjacent to shatterproof1 (SHELL) shell thickness gene
gacattgggatgctagtgggacacygtatcccaacacatgggatggtatc

SEQ ID NO: 3565 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatttggcaattttgctagtaaaargtcataatatttttttcagagacat

SEQ ID NO: 3566 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttgctagtaaaaggtcataatattyttttcagagacatgtaaaataaaaa

SEQ ID NO: 3567 - DNA, 50 bp, Artificial Sequence
  synthetic Elaeis guineensis (oil palm) single nucleotide polymorphism (SNP) in genomic region adjacent to shatterproof1 (SHELL) shell thickness gene
gatgcacctctttgacacttcatcytgaaaagatctcaactactatgagg

SEQ ID NO: 3568 - DNA, 50 bp, Artificial Sequence
  synthetic Elaeis guineensis (oil palm) single nucleotide polymorphism (SNP) in genomic region adjacent to shatterproof1 (SHELL) shell thickness gene
catgcacctttgttttaaagttctytatccactatgttgatagagtggtg

SEQ ID NO: 3569 - DNA, 50 bp, Artificial Sequence
  synthetic Elaeis guineensis (oil palm) single nucleotide polymorphism (SNP) in genomic region adjacent to shatterproof1 (SHELL) shell thickness gene
agctaggcccgcaacaattttggcygggttcgggcctaaacatagggtcc

SEQ ID NO: 3570 - DNA, 50 bp, Artificial Sequence
  synthetic Elaeis guineensis (oil palm) single nucleotide polymorphism (SNP) in genomic region adjacent to shatterproof1 (SHELL) shell thickness gene
gggttcgggcctaaacatagggtcygtttgtctttcgggccggctcaagc

SEQ ID NO: 3571 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctttggtccagcccgggctcggcytggctcgagcccaagctcgaattcc

SEQ ID NO: 3572 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcgtgccgtgcttgggagaagcccytgtgctctatccaaaacccttcaat

SEQ ID NO: 3573 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctcttcattccccgacggcgtgcwaaccctttccttcccctcccaccgc

SEQ ID NO: 3574 - DNA, 50 bp, Artificial Sequence
  synthetic Elaeis guineensis (oil palm) single nucleotide polymorphism (SNP) in genomic region adjacent to shatterproof1 (SHELL) shell thickness gene
tccccgacggcgtgctaaccctttscttcccctcccaccgccacctcgtc

SEQ ID NO: 3575 - DNA, 50 bp, Artificial Sequence
  synthetic Elaeis guineensis (oil palm) single nucleotide polymorphism (SNP) in genomic region adjacent to shatterproof1 (SHELL) shell thickness gene
cagtacatgttttgctttttctcayagccaaggaccgtcgaaccagaatc

SEQ ID NO: 3576 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtcgaaccagaatcagagctcgtgytggccggtcggcgatacgattcagt

SEQ ID NO: 3577 - DNA, 50 bp, Artificial Sequence
  synthetic Elaeis guineensis (oil palm) single nucleotide polymorphism (SNP) in genomic region adjacent to shatterproof1 (SHELL) shell thickness gene
gattcagtatgggtctgtactattytgtgcggggccgaactgatagggta

SEQ ID NO: 3578 - DNA, 50 bp, Artificial Sequence
  synthetic Elaeis guineensis (oil palm) single nucleotide polymorphism (SNP) in genomic region adjacent to shatterproof1 (SHELL) shell thickness gene
gagggcctccggcaggtgctctcargtcccttggcgtgggctcgtcggtc

SEQ ID NO: 3579 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtgggctcgtcggtcgttggagacrtcatggtggcagtgccatccatccg

SEQ ID NO: 3580 - DNA, 50 bp, Artificial Sequence
  synthetic Elaeis guineensis (oil palm) single nucleotide polymorphism (SNP) in genomic region adjacent to shatterproof1 (SHELL) shell thickness gene
catccatccggaggccttcgacggyctccagacatccagtaagactcttc

SEQ ID NO: 3581 - DNA, 50 bp, Artificial Sequence
  synthetic Elaeis guineensis (oil palm) single nucleotide polymorphism (SNP) in genomic region adjacent to shatterproof1 (SHELL) shell thickness gene
tagcccattaggaggatactcatgycgtgcttaagagaagcccctgtgct

SEQ ID NO: 3582 - DNA, 50 bp, Artificial Sequence
  synthetic Elaeis guineensis (oil palm) single nucleotide polymorphism (SNP) in genomic region adjacent to shatterproof1 (SHELL) shell thickness gene
gccatgctcctgccgtcgttgttcygctccctctcttctagcctcgctcg

SEQ ID NO: 3583 - DNA, 50 bp, Artificial Sequence
  synthetic Elaeis guineensis (oil palm) single nucleotide polymorphism (SNP) in genomic region adjacent to shatterproof1 (SHELL) shell thickness gene
accggcatctttcttccccaccttrttgccgccatggtgtgcccttcctt

SEQ ID NO: 3584 - DNA, 50 bp, Artificial Sequence
  synthetic Elaeis guineensis (oil palm) single nucleotide polymorphism (SNP) in genomic region adjacent to shatterproof1 (SHELL) shell thickness gene
gggccttaaattttaaaatattttygaacctaagctcgccttgacgtctg

SEQ ID NO: 3585 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccttaaattttaaaatattttcgarcctaagctcgccttgacgtctgaaa

SEQ ID NO: 3586 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttttcgaacctaagctcgccttgamgtctgaaaaaatatttcggaccggg

SEQ ID NO: 3587 - DNA, 50 bp, Artificial Sequence
  synthetic Elaeis guineensis (oil palm) single nucleotide polymorphism (SNP) in genomic region adjacent to shatterproof1 (SHELL) shell thickness gene
acctatttccagccctatttctccmtggaataggatgccccactgtccca

SEQ ID NO: 3588 - DNA, 50 bp, Artificial Sequence
  synthetic Elaeis guineensis (oil palm) single nucleotide polymorphism (SNP) in genomic region adjacent to shatterproof1 (SHELL) shell thickness gene
aacaagacaggacagctgggacgcycctcgtcctgctgggacgtcccctg

SEQ ID NO: 3589 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgcctcttaatacaatttggctcaytaacgtgcatcacatgctatatgtg

SEQ ID NO: 3590 - DNA, 50 bp, Artificial Sequence
  synthetic Elaeis guineensis (oil palm) single nucleotide polymorphism (SNP) in genomic region adjacent to shatterproof1 (SHELL) shell thickness gene
cctctttctctttctcccccctttycctctctctttcccttccattttgt

SEQ ID NO: 3591 - DNA, 50 bp, Artificial Sequence
  synthetic Elaeis guineensis (oil palm) single nucleotide polymorphism (SNP) in genomic region adjacent to shatterproof1 (SHELL) shell thickness gene
gataccaactacctcactagaaccmaaagaacctattggttggtgctatt

SEQ ID NO: 3592 - DNA, 50 bp, Artificial Sequence
  synthetic Elaeis guineensis (oil palm) single nucleotide polymorphism (SNP) in genomic region adjacent to shatterproof1 (SHELL) shell thickness gene
tggcaaggttctaaatactagcccwaataggacatgcctttactgacata

SEQ ID NO: 3593 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctggtggtatactgaaccctggtrccataccagcactgtgccgactggc

SEQ ID NO: 3594 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtggtttcattctgttgtaactgcygagctttattccttaactgcagcga

SEQ ID NO: 3595 - DNA, 50 bp, Artificial Sequence
  synthetic Elaeis guineensis (oil palm) single nucleotide polymorphism (SNP) in genomic region adjacent to shatterproof1 (SHELL) shell thickness gene
gagcagatcacacttcaagatactwtggatggcacaggatattcgacatt

SEQ ID NO: 3596 - DNA, 50 bp, Artificial Sequence
  synthetic Elaeis guineensis (oil palm) single nucleotide polymorphism (SNP) in genomic region adjacent to shatterproof1 (SHELL) shell thickness gene
agaaacaaatgttatgaaccccaarctgatgcgcaaaacaaaaacaaaaa

SEQ ID NO: 3597 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttgttaaatattccaatcttccttyttcttgttatttgaacttcagaata

SEQ ID NO: 3598 - DNA, 50 bp, Artificial Sequence
  synthetic Elaeis guineensis (oil palm) single nucleotide polymorphism (SNP) in genomic region adjacent to shatterproof1 (SHELL) shell thickness gene
aacttcactgagaaaggaggcactytatgttactgaatcttcttttgatt

SEQ ID NO: 3599 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaggacaccagtcttgaggataggrccgacaccgccaccccccaaagcag

SEQ ID NO: 3600 - DNA, 50 bp, Artificial Sequence
  synthetic Elaeis guineensis (oil palm) single nucleotide polymorphism (SNP) in genomic region adjacent to shatterproof1 (SHELL) shell thickness gene
attcccgtttgtatgacatccatgwaccagctgttattgtaaagcctatc

SEQ ID NO: 3601 - DNA, 50 bp, Artificial Sequence
  synthetic Elaeis guineensis (oil palm) single nucleotide polymorphism (SNP) in genomic region adjacent to shatterproof1 (SHELL) shell thickness gene
tattgtgaatcctgattctaggacyatggtcagaagtcatatatgttact

SEQ ID NO: 3602 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcccctttgcagtgcaatacggcarcaactgataaatgctgaagatatac

SEQ ID NO: 3603 - DNA, 50 bp, Artificial Sequence
  synthetic Elaeis guineensis (oil palm) single nucleotide polymorphism (SNP) in genomic region adjacent to shatterproof1 (SHELL) shell thickness gene
atgctttcattataaaatcaacatkgtggtgaattaccaagttcattatt

SEQ ID NO: 3604 - DNA, 50 bp, Artificial Sequence
  synthetic Elaeis guineensis (oil palm) single nucleotide polymorphism (SNP) in genomic region adjacent to shatterproof1 (SHELL) shell thickness gene
acttctttacaataatatgcatcaygtggatttccacttagatcctgtca

SEQ ID NO: 3605 - DNA, 50 bp, Artificial Sequence
  synthetic Elaeis guineensis (oil palm) single nucleotide polymorphism (SNP) in genomic region adjacent to shatterproof1 (SHELL) shell thickness gene
tactatctctatattgcttacacaycaaaaatcttgtgatttggagagct

SEQ ID NO: 3606 - DNA, 50 bp, Artificial Sequence
  synthetic Elaeis guineensis (oil palm) single nucleotide polymorphism (SNP) in genomic region adjacent to shatterproof1 (SHELL) shell thickness gene
atttaatgcaaacatgtaagaagakgcctgttcaaagatcatgtgttaaa

SEQ ID NO: 3607 - DNA, 50 bp, Artificial Sequence
  synthetic Elaeis guineensis (oil palm) single nucleotide polymorphism (SNP) in genomic region adjacent to shatterproof1 (SHELL) shell thickness gene
cagatgttagtaaagatttatactkctacagaggtatataggtatatgtg

SEQ ID NO: 3608 - DNA, 50 bp, Artificial Sequence
  synthetic Elaeis guineensis (oil palm) single nucleotide polymorphism (SNP) in genomic region adjacent to shatterproof1 (SHELL) shell thickness gene
cttatttcagccgtagtcaattaawcataactaaccgtgttctttcccat

SEQ ID NO: 3609 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctatgaagttcatgctcgcatcttrttatctatatactttcgagttgtct

SEQ ID NO: 3610 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccttcatttcttcttcaattggttmaattgttattcttctccaatgtatt

SEQ ID NO: 3611 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttgtgttcttttccctgtgttatragtcatctctatcgatcagaatttg

SEQ ID NO: 3612 - DNA, 50 bp, Artificial Sequence
  synthetic Elaeis guineensis (oil palm) single nucleotide polymorphism (SNP) in genomic region adjacent to shatterproof1 (SHELL) shell thickness gene
tagtttgagaatttgatctagtttratgttacgttgttaacccttcatga

SEQ ID NO: 3613 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcaactaatggcaatagattaaacrtgcatccctttaaggaaattttggt

SEQ ID NO: 3614 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgattgacgactatatgttccttamgttggaaaaataataagtgtaccac

SEQ ID NO: 3615 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcttaaaattgtcttattgagaatyaaatgacaacagaaacagcaatttg

SEQ ID NO: 3616 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctctaaacttcccacacaccaaaartcatttgacttgaagacctttagcc

SEQ ID NO: 3617 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcatgctcgtgatactattttgtasgctcaaggaacaaagtgttatagga

SEQ ID NO: 3618 - DNA, 50 bp, Artificial Sequence
  synthetic Elaeis guineensis (oil palm) single nucleotide polymorphism (SNP) in genomic region adjacent to shatterproof1 (SHELL) shell thickness gene
gctggtcctcccggacaaggtaacytcctcaacttgttgtttcatttatg

SEQ ID NO: 3619 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttgcaagcaacaaaaatgtttttgrgttaaatatctcataatcatatgtt

SEQ ID NO: 3620 - DNA, 50 bp, Artificial Sequence
  synthetic Elaeis guineensis (oil palm) single nucleotide polymorphism (SNP) in genomic region adjacent to shatterproof1 (SHELL) shell thickness gene
atcattatagttatctaatttgctwtggtgaggaaggccgacatgctgca

SEQ ID NO: 3621 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgcacggaagcatgtgtattgcgcygttttctgttttgtctgtccatgtg

SEQ ID NO: 3622 - DNA, 50 bp, Artificial Sequence
  synthetic Elaeis guineensis (oil palm) single nucleotide polymorphism (SNP) in genomic region adjacent to shatterproof1 (SHELL) shell thickness gene
attaattatagaagtttatgattgwggatttcaatgctgatcattatctg

SEQ ID NO: 3623 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggagaacactaaaagaaccagcatrtgctggaatatgtttttcatataga

SEQ ID NO: 3624 - DNA, 50 bp, Artificial Sequence
  synthetic Elaeis guineensis (oil palm) single nucleotide polymorphism (SNP) in genomic region adjacent to shatterproof1 (SHELL) shell thickness gene
attttagatgctttatagcaccttygttggtttcaatcctgctatcagga

SEQ ID NO: 3625 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgttggtattctgtgaagttaactsgtcttcatgttccttcaatcagaaa

SEQ ID NO: 3626 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgctcctgtaaaccgcctgacaccrgagactgaatcagaaaagttgcttt

SEQ ID NO: 3627 - DNA, 50 bp, Artificial Sequence
  synthetic Elaeis guineensis (oil palm) single nucleotide polymorphism (SNP) in genomic region adjacent to shatterproof1 (SHELL) shell thickness gene
catatgtctggtatttctagagaawttgagtacaaatgtcaggagatgta

SEQ ID NO: 3628 - DNA, 50 bp, Artificial Sequence
  synthetic Elaeis guineensis (oil palm) single nucleotide polymorphism (SNP) in genomic region adjacent to shatterproof1 (SHELL) shell thickness gene
cattgaattaacccattaaatttcrtggataattgttctcttttggccca

SEQ ID NO: 3629 - DNA, 50 bp, Artificial Sequence
  synthetic Elaeis guineensis (oil palm) single nucleotide polymorphism (SNP) in genomic region adjacent to shatterproof1 (SHELL) shell thickness gene
gttccagctacagaagaagaagcaygccgggtacttgagcgcattgatgc

SEQ ID NO: 3630 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctgagacaatgtttagttaattcawaatctagctatcttctttagtgaaa

SEQ ID NO: 3631 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatccttttttttcgttgagcctckataggaaatattcctggcaagggcc

SEQ ID NO: 3632 - DNA, 50 bp, Artificial Sequence
  synthetic Elaeis guineensis (oil palm) single nucleotide polymorphism (SNP) in genomic region adjacent to shatterproof1 (SHELL) shell thickness gene
cctgggattgaacctccgacttctygtattgcttgtcatgttaagattac

SEQ ID NO: 3633 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcttgtattgcttgtcatgttaagrttactttgtattgctcaagtacctc

SEQ ID NO: 3634 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttcttctcagggaaagcgttggttrgtgactggattccatgcattacctg

SEQ ID NO: 3635 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggaaagcgttggttggtgactggawtccatgcattacctgtgcctaatct

SEQ ID NO: 3636 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcaatcaagcatatttatgctccartagcctggttggcttctaaacactc

SEQ ID NO: 3637 - DNA, 50 bp, Artificial Sequence
  synthetic Elaeis guineensis (oil palm) single nucleotide polymorphism (SNP) in genomic region adjacent to shatterproof1 (SHELL) shell thickness gene
cttctaaacactcgaacaagtatawtcacattttgatagttttgtgtaat

SEQ ID NO: 3638 - DNA, 50 bp, Artificial Sequence
  synthetic Elaeis guineensis (oil palm) single nucleotide polymorphism (SNP) in genomic region adjacent to shatterproof1 (SHELL) shell thickness gene
gagagaaagcaatcggttctattcrtgtatcaaattcatgaaaaatgaat

SEQ ID NO: 3639 - DNA, 50 bp, Artificial Sequence
  synthetic Elaeis guineensis (oil palm) single nucleotide polymorphism (SNP) in genomic region adjacent to shatterproof1 (SHELL) shell thickness gene
gatttatccgctgccttcggtgtgmagttaccctatgatcaagtcatcga

SEQ ID NO: 3640 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagttaccctatgatcaagtcatcraaaggatcccatccatcatttctaa

SEQ ID NO: 3641 - DNA, 50 bp, Artificial Sequence
  synthetic Elaeis guineensis (oil palm) single nucleotide polymorphism (SNP) in genomic region adjacent to shatterproof1 (SHELL) shell thickness gene
aattaaaactgttattaaggcaagyctatcctatatatcaaattcattga

SEQ ID NO: 3642 - DNA, 50 bp, Artificial Sequence
  synthetic Elaeis guineensis (oil palm) single nucleotide polymorphism (SNP) in genomic region adjacent to shatterproof1 (SHELL) shell thickness gene
atcctatatatcaaattcattgatrgttcataacctcaaatttgcaacta

SEQ ID NO: 3643 - DNA, 50 bp, Artificial Sequence
  synthetic Elaeis guineensis (oil palm) single nucleotide polymorphism (SNP) in genomic region adjacent to shatterproof1 (SHELL) shell thickness gene
caatagcatgtcatagttataatcmgatggaaaatctaaatctacttgtt

SEQ ID NO: 3644 - DNA, 50 bp, Artificial Sequence
  synthetic Elaeis guineensis (oil palm) single nucleotide polymorphism (SNP) in genomic region adjacent to shatterproof1 (SHELL) shell thickness gene
catagttgttttataatgacttggsagattgtagttgtttcaagtcatct

SEQ ID NO: 3645 - DNA, 50 bp, Artificial Sequence
  synthetic Elaeis guineensis (oil palm) single nucleotide polymorphism (SNP) in genomic region adjacent to shatterproof1 (SHELL) shell thickness gene
gactttgtatggtagtggtggacckccatataactttaatcagaatgtaa

SEQ ID NO: 3646 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccaggttttgtttaaacgggccgtwcccatttagtcgcgcccggcacggc

SEQ ID NO: 3647 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttaatttttatatcattgcatgtcyggtcatgcaaaggtcaagcctaaaa

SEQ ID NO: 3648 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcaaaggtcaagcctaaaaagcaakccatacaggagcgtgcggccattag

SEQ ID NO: 3649 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcattgattttttatgtttcctttygaatcttttctatgaggcatgcttt

SEQ ID NO: 3650 - DNA, 50 bp, Artificial Sequence
  synthetic Elaeis guineensis (oil palm) single nucleotide polymorphism (SNP) in genomic region adjacent to shatterproof1 (SHELL) shell thickness gene
attgattttttatgtttccttttgmatcttttctatgaggcatgctttct

SEQ ID NO: 3651 - DNA, 50 bp, Artificial Sequence
  synthetic Elaeis guineensis (oil palm) single nucleotide polymorphism (SNP) in genomic region adjacent to shatterproof1 (SHELL) shell thickness gene
actcataacaatgagctgcacaackgaaacttgttccaaattctgcacat

SEQ ID NO: 3652 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttaatgatctcgtcctctgccttcyttaagaacccactcatagcatcatg

SEQ ID NO: 3653 - DNA, 50 bp, Artificial Sequence
  synthetic Elaeis guineensis (oil palm) single nucleotide polymorphism (SNP) in genomic region adjacent to shatterproof1 (SHELL) shell thickness gene
cctctgccttctttaagaacccacwcatagcatcatgaaattgctggcta

SEQ ID NO: 3654 - DNA, 50 bp, Artificial Sequence
  synthetic Elaeis guineensis (oil palm) single nucleotide polymorphism (SNP) in genomic region adjacent to shatterproof1 (SHELL) shell thickness gene
acacccaaggccagcgacagcttgkaggccaagctttctgcactcaaggt

SEQ ID NO: 3655 - DNA, 50 bp, Artificial Sequence
  synthetic Elaeis guineensis (oil palm) single nucleotide polymorphism (SNP) in genomic region adjacent to shatterproof1 (SHELL) shell thickness gene
gccagcgacagcttggaggccaagytttctgcactcaaggtcatctcgta

SEQ ID NO: 3656 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctgattgaattttaatgatgacaawtgcaaaattcaacagcactgaactt

SEQ ID NO: 3657 - DNA, 50 bp, Artificial Sequence
  synthetic Elaeis guineensis (oil palm) single nucleotide polymorphism (SNP) in genomic region adjacent to shatterproof1 (SHELL) shell thickness gene
tagaaatggaatgtgtgggtgagaygaaaactaggaggacatggaaagtt

SEQ ID NO: 3658 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttgcaattcaaataggatattgtraaatttattctcataatcaagtgta

SEQ ID NO: 3659 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtgaaatttattctcataatcaagkgtaaagttgttgatattctttttta

SEQ ID NO: 3660 - DNA, 50 bp, Artificial Sequence
  synthetic Elaeis guineensis (oil palm) single nucleotide polymorphism (SNP) in genomic region adjacent to shatterproof1 (SHELL) shell thickness gene
actcaaatgtacttgaacattttgycgattgttcaaattatgaaagaaag

SEQ ID NO: 3661 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctgtctttagtaaataagccatgamcgctgcatgatatatgacattactt

SEQ ID NO: 3662 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtcacatggaagaattgcaaagtayatacataaataaaaatttgccatag

SEQ ID NO: 3663 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggaagaattgcaaagtacatacatmaataaaaatttgccatagtatcata

SEQ ID NO: 3664 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttaaaccactactttatctactaytttactagtgattgacatgcgatag

SEQ ID NO: 3665 - DNA, 50 bp, Artificial Sequence
  synthetic Elaeis guineensis (oil palm) single nucleotide polymorphism (SNP) in genomic region adjacent to shatterproof1 (SHELL) shell thickness gene
actattttactagtgattgacatgygatagttcacttttttcctatccag

SEQ ID NO: 3666 - DNA, 50 bp, Artificial Sequence
  synthetic Elaeis guineensis (oil palm) single nucleotide polymorphism (SNP) in genomic region adjacent to shatterproof1 (SHELL) shell thickness gene
tagtgattgacatgcgatagttcayttttttcctatccagaatagaattg

SEQ ID NO: 3667 - DNA, 50 bp, Artificial Sequence
  synthetic Elaeis guineensis (oil palm) single nucleotide polymorphism (SNP) in genomic region adjacent to shatterproof1 (SHELL) shell thickness gene
tagatttacctcaagagtttcaaaygatttcttaagataattgacctctg

SEQ ID NO: 3668 - DNA, 50 bp, Artificial Sequence
  synthetic Elaeis guineensis (oil palm) single nucleotide polymorphism (SNP) in genomic region adjacent to shatterproof1 (SHELL) shell thickness gene
cgcatccactctcttaaaagcaaayggtatatcaagcactgccttgagaa

SEQ ID NO: 3669 - DNA, 50 bp, Artificial Sequence
  synthetic Elaeis guineensis (oil palm) single nucleotide polymorphism (SNP) in genomic region adjacent to shatterproof1 (SHELL) shell thickness gene
atatataagtaaataatcaaccacraaaataccagtaaaaataacttcat

SEQ ID NO: 3670 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatcaaccacaaaaataccagtaaraataacttcatttgagttaaaattg

SEQ ID NO: 3671 - DNA, 50 bp, Artificial Sequence
  synthetic Elaeis guineensis (oil palm) single nucleotide polymorphism (SNP) in genomic region adjacent to shatterproof1 (SHELL) shell thickness gene
atacagaagacttcaacaactgaakggctaaaacaaatggttcagaaaat

SEQ ID NO: 3672 - DNA, 50 bp, Artificial Sequence
  synthetic Elaeis guineensis (oil palm) single nucleotide polymorphism (SNP) in genomic region adjacent to shatterproof1 (SHELL) shell thickness gene
gatacttgatattgcatttcattawgcatgaccaaaaaaagaaagattaa

SEQ ID NO: 3673 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgcatgaccaaaaaaagaaagattraacagctacaattgatacatgacag

SEQ ID NO: 3674 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcatatagattgctaccgaacagcwtttttattttactatcattttgact

SEQ ID NO: 3675 - DNA, 50 bp, Artificial Sequence
  synthetic Elaeis guineensis (oil palm) single nucleotide polymorphism (SNP) in genomic region adjacent to shatterproof1 (SHELL) shell thickness gene
acaaaactctagttaatatcttgckgccattgggattaggaagctcaccg

SEQ ID NO: 3676 - DNA, 50 bp, Artificial Sequence
  synthetic Elaeis guineensis (oil palm) single nucleotide polymorphism (SNP) in genomic region adjacent to shatterproof1 (SHELL) shell thickness gene
cttgcggccattgggattaggaagytcaccgaaacaaaagaagcaaactg

SEQ ID NO: 3677 - DNA, 50 bp, Artificial Sequence
  synthetic Elaeis guineensis (oil palm) single nucleotide polymorphism (SNP) in genomic region adjacent to shatterproof1 (SHELL) shell thickness gene
aggccaacaaagaaagaacacctawcccttggctaaaatatagaacaata

SEQ ID NO: 3678 - DNA, 50 bp, Artificial Sequence
  synthetic Elaeis guineensis (oil palm) single nucleotide polymorphism (SNP) in genomic region adjacent to shatterproof1 (SHELL) shell thickness gene
acctaacccttggctaaaatatagracaataacctttttggaggcaagtg

SEQ ID NO: 3679 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcaaaggggacagatggttacatgyaaactccaaagcaccatacctcacc

SEQ ID NO: 3680 - DNA, 50 bp, Artificial Sequence
  synthetic Elaeis guineensis (oil palm) single nucleotide polymorphism (SNP) in genomic region adjacent to shatterproof1 (SHELL) shell thickness gene
atctattttccaacatacaccgagrttgagggagagtttatacgtgaata

SEQ ID NO: 3681 - DNA, 50 bp, Artificial Sequence
  synthetic Elaeis guineensis (oil palm) single nucleotide polymorphism (SNP) in genomic region adjacent to shatterproof1 (SHELL) shell thickness gene
cagttcataacggtgatcaaatctrattaggaaaaaatgagcactggcgt

SEQ ID NO: 3682 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagcatttttatcacaatattggtmataaagttcaaaaagagaaagagat

SEQ ID NO: 3683 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggagaataacagcaggaagagaagsaagaagaaggaagggactggcatat

SEQ ID NO: 3684 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttcttttcttttcttctccattttycctttttttttttttgttgcctcct

SEQ ID NO: 3685 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaggagacgagaagatcatagtagyagagcaagactaaaacaattaatta

SEQ ID NO: 3686 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaggccgagaaaacattgtcggccrgagagaacaaaaatgtggcggagat

SEQ ID NO: 3687 - DNA, 50 bp, Artificial Sequence
  synthetic Elaeis guineensis (oil palm) single nucleotide polymorphism (SNP) in genomic region adjacent to shatterproof1 (SHELL) shell thickness gene
atatagatatattgatatttatttygtatttgatctatttttgatctcaa

SEQ ID NO: 3688 - DNA, 50 bp, Artificial Sequence
  synthetic Elaeis guineensis (oil palm) single nucleotide polymorphism (SNP) in genomic region adjacent to shatterproof1 (SHELL) shell thickness gene
caatgtacttattttaaattggtaygagcggctgtttgtatagaagaaaa

SEQ ID NO: 3689 - DNA, 50 bp, Artificial Sequence
  synthetic Elaeis guineensis (oil palm) single nucleotide polymorphism (SNP) in genomic region adjacent to shatterproof1 (SHELL) shell thickness gene
tacttattttaaattggtacgagcsgctgtttgtatagaagaaaaaaatt

SEQ ID NO: 3690 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccccgcgtctggatctctgggaaasgacaagagaaacgggaaagcggaag

SEQ ID NO: 3691 - DNA, 50 bp, Artificial Sequence
  synthetic Elaeis guineensis (oil palm) single nucleotide polymorphism (SNP) in genomic region adjacent to shatterproof1 (SHELL) shell thickness gene
cgtgaaacgggaatcgcggcgtggrgtggttgcagcatgtgcgcgcccca

SEQ ID NO: 3692 - DNA, 50 bp, Artificial Sequence
  synthetic Elaeis guineensis (oil palm) single nucleotide polymorphism (SNP) in genomic region adjacent to shatterproof1 (SHELL) shell thickness gene
gattctcctgggaggttccaggggmgcgacgtcagcgggtctgcgaggcg

SEQ ID NO: 3693 - DNA, 50 bp, Artificial Sequence
  synthetic Elaeis guineensis (oil palm) single nucleotide polymorphism (SNP) in genomic region adjacent to shatterproof1 (SHELL) shell thickness gene
tggttggatagatatcaagtccacmgaccagtgagatttttttttttttt

SEQ ID NO: 3694 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagtatcattctattcttctctctmttgcttgatctggtataatacccga

SEQ ID NO: 3695 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatcattctattcttctctctcttrcttgatctggtataatacccgatga

SEQ ID NO: 3696 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttaacacatttgaagaaaaatttrcatttagaagttccatgttaagata

SEQ ID NO: 3697 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagataatcgatggcaattcatggygtatggccttaattaaaatgagtgt

SEQ ID NO: 3698 - DNA, 50 bp, Artificial Sequence
  synthetic Elaeis guineensis (oil palm) single nucleotide polymorphism (SNP) in genomic region adjacent to shatterproof1 (SHELL) shell thickness gene
agtttctttttgtatgtcggtctamtcttctttcattgtggtagtaccca

SEQ ID NO: 3699 - DNA, 50 bp, Artificial Sequence
  synthetic Elaeis guineensis (oil palm) single nucleotide polymorphism (SNP) in genomic region adjacent to shatterproof1 (SHELL) shell thickness gene
accaagtaacttccttgattttgcyaggtggtctaagataattaaaggtc

SEQ ID NO: 3700 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatattggttgggtgatttacacaygatgagccattttttaagaggaaga

SEQ ID NO: 3701 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgaggtgataaatgcagtatatatraagatcaattgcggtgatagcactt

SEQ ID NO: 3702 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcagtatatatgaagatcaattgcrgtgatagcacttacatacaacatct

SEQ ID NO: 3703 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcctcatactgatattctttttccygttgaatgcatgaaactattggttt

SEQ ID NO: 3704 - DNA, 50 bp, Artificial Sequence
  synthetic Elaeis guineensis (oil palm) single nucleotide polymorphism (SNP) in genomic region adjacent to shatterproof1 (SHELL) shell thickness gene
caaatcaaaattttatataatagarattttatatcaatgatccaaattat

SEQ ID NO: 3705 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttattgaatacaatctaccatctcmaaattacttacacataaaatatcat

SEQ ID NO: 3706 - DNA, 50 bp, Artificial Sequence
  synthetic Elaeis guineensis (oil palm) single nucleotide polymorphism (SNP) in genomic region adjacent to shatterproof1 (SHELL) shell thickness gene
atgtatcaaatagtaaaaaattgartagtctaaataaaattgaattatat

SEQ ID NO: 3707 - DNA, 50 bp, Artificial Sequence
  synthetic Elaeis guineensis (oil palm) single nucleotide polymorphism (SNP) in genomic region adjacent to shatterproof1 (SHELL) shell thickness gene
atttttagattatgataagttagarattttcagatcatatgatttttgat

SEQ ID NO: 3708 - DNA, 50 bp, Artificial Sequence
  synthetic Elaeis guineensis (oil palm) single nucleotide polymorphism (SNP) in genomic region adjacent to shatterproof1 (SHELL) shell thickness gene
atttttgatatgtaagtagttttgmgacagtaggttacattcaatgactt

SEQ ID NO: 3709 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaaagttaaaaattttctggccaayttatttctgtttgttgattttttaa

SEQ ID NO: 3710 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttgttgattttttaaaataaaaartaatatgatcaggtaggtcttaaat

SEQ ID NO: 3711 - DNA, 50 bp, Artificial Sequence
  synthetic Elaeis guineensis (oil palm) single nucleotide polymorphism (SNP) in genomic region adjacent to shatterproof1 (SHELL) shell thickness gene
atcaggtaggtcttaaatctaaacwtcacgttgctgttagattctaattt

SEQ ID NO: 3712 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatttaatgatccaatcttttctckggagcttcttattttattgcatgga

SEQ ID NO: 3713 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaccgccattaacaatgcaagaaakgtatcatttttatattattattact

SEQ ID NO: 3714 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttactggtcgtaatctatttgtttrcatgtttgtttaatcttttatggac

SEQ ID NO: 3715 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccagtgcgaatatgtttgagtttcygggggacattaataattattatgat

SEQ ID NO: 3716 - DNA, 50 bp, Artificial Sequence
  synthetic Elaeis guineensis (oil palm) single nucleotide polymorphism (SNP) in genomic region adjacent to shatterproof1 (SHELL) shell thickness gene
atattataaaatattaatttgaatytaatttattaaattaatttaaatta

SEQ ID NO: 3717 - DNA, 50 bp, Artificial Sequence
  synthetic Elaeis guineensis (oil palm) single nucleotide polymorphism (SNP) in genomic region adjacent to shatterproof1 (SHELL) shell thickness gene
caagagagaaagtctctgtacaccrtaataaagttgacgtaaaacgtatc

SEQ ID NO: 3718 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttaatatcattatcatctttatcaytagctatttaagtaatataaataaa

SEQ ID NO: 3719 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatcattatcatctttatcattagytatttaagtaatataaataaaatta

SEQ ID NO: 3720 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtaggggacagggaatggatgctarcaaaagatctctttccttctggaaa

SEQ ID NO: 3721 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctagcaaaagatctctttccttctrgaaaaattaatccactttcacacgt

SEQ ID NO: 3722 - DNA, 50 bp, Artificial Sequence
  synthetic Elaeis guineensis (oil palm) single nucleotide polymorphism (SNP) in genomic region adjacent to shatterproof1 (SHELL) shell thickness gene
cattaaaattgatatccatatctcycaagttactactcctctgtctaaaa

SEQ ID NO: 3723 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaattgatatccatatctcccaagwtactactcctctgtctaaaatcatt

SEQ ID NO: 3724 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcaggtagatggggatgcaggggtrgggacaaaatattatgatgttgcaa

SEQ ID NO: 3725 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcaattctgaatttttaatgataasagctcaatcatgggctccaagaaca

SEQ ID NO: 3726 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggaaatatggtagaatcttatagcwaaggagctttgctgacaatctaaga

SEQ ID NO: 3727 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcttatagctaaggagctttgctgrcaatctaagaagaaggttgagtagt

SEQ ID NO: 3728 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttgagtagtgatggaaggcaaaggrccctgcaaataggcaagagtaattt

SEQ ID NO: 3729 - DNA, 50 bp, Artificial Sequence
  synthetic Elaeis guineensis (oil palm) single nucleotide polymorphism (SNP) in genomic region adjacent to shatterproof1 (SHELL) shell thickness gene
tagtgatggaaggcaaagggccctrcaaataggcaagagtaattttattc

SEQ ID NO: 3730 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcaagagtaattttattctaaacakgtaaataattacagatacacaaggc

SEQ ID NO: 3731 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttcatgtttggggaaaaaattctwgtactgaaattatctaaactaactt

SEQ ID NO: 3732 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcttacttaaaactagtctctcttrgaaaagaaaaaaatcctacttaaat

SEQ ID NO: 3733 - DNA, 50 bp, Artificial Sequence
  synthetic Elaeis guineensis (oil palm) single nucleotide polymorphism (SNP) in genomic region adjacent to shatterproof1 (SHELL) shell thickness gene
gccatgaagcccaatttatgcttargggcctccatatagatatgttgaca

SEQ ID NO: 3734 - DNA, 50 bp, Artificial Sequence
  synthetic Elaeis guineensis (oil palm) single nucleotide polymorphism (SNP) in genomic region adjacent to shatterproof1 (SHELL) shell thickness gene
gccaacacatttattatttacaaargagaaaatatagctcagcacccgtt

SEQ ID NO: 3735 - DNA, 50 bp, Artificial Sequence
  synthetic Elaeis guineensis (oil palm) single nucleotide polymorphism (SNP) in genomic region adjacent to shatterproof1 (SHELL) shell thickness gene
cattgcgcatggattctatgtcagstaattgatcatttgtttaagaaaaa

SEQ ID NO: 3736 - DNA, 50 bp, Artificial Sequence
  synthetic Elaeis guineensis (oil palm) single nucleotide polymorphism (SNP) in genomic region adjacent to shatterproof1 (SHELL) shell thickness gene
atttatacttgtaaatgagcttcawtgccattctttaaccgtacaatgct

SEQ ID NO: 3737 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagtgagctttaaaactatcctttmataacataatgttttcgcttttagc

SEQ ID NO: 3738 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttcgcttttagctagtatggtattrtaggttgattttgatctaaatggta

SEQ ID NO: 3739 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtgagaatgtattgtttatgtagayaacttaacttgctaatgaatttttt

SEQ ID NO: 3740 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcatggagtaaatcaattatatcgrtctatgatttaaaataaatattaaa

SEQ ID NO: 3741 - DNA, 50 bp, Artificial Sequence
  synthetic Elaeis guineensis (oil palm) single nucleotide polymorphism (SNP) in genomic region adjacent to shatterproof1 (SHELL) shell thickness gene
agagaattataaaaaaataattatraaaaatattaaaaaatatataaatt

SEQ ID NO: 3742 - DNA, 50 bp, Artificial Sequence
  synthetic Elaeis guineensis (oil palm) single nucleotide polymorphism (SNP) in genomic region adjacent to shatterproof1 (SHELL) shell thickness gene
acaaataatctctattctaattttyttcttatgtctctcgtacactttta

SEQ ID NO: 3743 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtctctcgtacacttttacatccamagaaaactctaatgattcttttaaa

SEQ ID NO: 3744 - DNA, 50 bp, Artificial Sequence
  synthetic Elaeis guineensis (oil palm) single nucleotide polymorphism (SNP) in genomic region adjacent to shatterproof1 (SHELL) shell thickness gene
actctaatgattcttttaaatagarcattatatagatgaaagtttaactc

SEQ ID NO: 3745 - DNA, 50 bp, Artificial Sequence
  synthetic Elaeis guineensis (oil palm) single nucleotide polymorphism (SNP) in genomic region adjacent to shatterproof1 (SHELL) shell thickness gene
taaaaaattaaaaatttattaaaayataaattttaataatttttagaagg

SEQ ID NO: 3746 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaataattaaatggagtaacattgraaatagaatcttaaagttattaaaa

SEQ ID NO: 3747 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaactaatcatcaactaaaaataraattctaaatgaattgagacttgtt

SEQ ID NO: 3748 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtgctggaaaatctgaacctaattrgtggttaatatctcaattcaaattt

SEQ ID NO: 3749 - DNA, 50 bp, Artificial Sequence
  synthetic Elaeis guineensis (oil palm) single nucleotide polymorphism (SNP) in genomic region adjacent to shatterproof1 (SHELL) shell thickness gene
atttttaattttttttaagggtaakaacccacaggcatgtttaaagcgaa

SEQ ID NO: 3750 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctactggagatcgggaaacacagawgagttcatgttcatttctaaatttc

SEQ ID NO: 3751 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttataacaccaaatggagcaatcawgtttagttgatgtatatatacaaca

SEQ ID NO: 3752 - DNA, 50 bp, Artificial Sequence
  synthetic Elaeis guineensis (oil palm) single nucleotide polymorphism (SNP) in genomic region adjacent to shatterproof1 (SHELL) shell thickness gene
cttaattagcattcttttgtagaaratgggcaatgactgcttcatgatgg

SEQ ID NO: 3753 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgactgcttcatgatggaaaatgtrgctgttattgatccttttattgttc

SEQ ID NO: 3754 - DNA, 50 bp, Artificial Sequence
  synthetic Elaeis guineensis (oil palm) single nucleotide polymorphism (SNP) in genomic region adjacent to shatterproof1 (SHELL) shell thickness gene
gctgctttacggatggatttgtccrtcggctcaacaatgaataattaata

SEQ ID NO: 3755 - DNA, 50 bp, Artificial Sequence
  synthetic Elaeis guineensis (oil palm) single nucleotide polymorphism (SNP) in genomic region adjacent to shatterproof1 (SHELL) shell thickness gene
attacaataataaataaaaaatttrtgataaaattatcattagaatctac

SEQ ID NO: 3756 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaaatttatgataaaattatcatkagaatctacatgaatctctaggccc

SEQ ID NO: 3757 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctctaggcccttcagctgttcatraccatgcaaaaactccactaattag

SEQ ID NO: 3758 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctaggcccttcagctgttcataascatgcaaaaactccactaattagct

SEQ ID NO: 3759 - DNA, 50 bp, Artificial Sequence
  synthetic Elaeis guineensis (oil palm) single nucleotide polymorphism (SNP) in genomic region adjacent to shatterproof1 (SHELL) shell thickness gene
cactgagattatataagaaaaattrgaattatataaacttgtactattaa

SEQ ID NO: 3760 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagggaagtgtgacttgcctttccytctcctttttctttactctttaata

SEQ ID NO: 3761 - DNA, 50 bp, Artificial Sequence
  synthetic Elaeis guineensis (oil palm) single nucleotide polymorphism (SNP) in genomic region adjacent to shatterproof1 (SHELL) shell thickness gene
gattcctgggccagtgaattatgawgctttgcatgaactataaatgatcc

SEQ ID NO: 3762 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcccttgctaaaacttttggcacargtagaaaagctctaaaacctcacat

SEQ ID NO: 3763 - DNA, 50 bp, Artificial Sequence
  synthetic Elaeis guineensis (oil palm) single nucleotide polymorphism (SNP) in genomic region adjacent to shatterproof1 (SHELL) shell thickness gene
cgaatttataataaaacaacaactmaattacaacttaatttaaatattgg

SEQ ID NO: 3764 - DNA, 50 bp, Artificial Sequence
  synthetic Elaeis guineensis (oil palm) single nucleotide polymorphism (SNP) in genomic region adjacent to shatterproof1 (SHELL) shell thickness gene
tccactacgaacagaacgcatgttwtgtgatgcttgtctcatgggtcact

SEQ ID NO: 3765 - DNA, 50 bp, Artificial Sequence
  synthetic Elaeis guineensis (oil palm) single nucleotide polymorphism (SNP) in genomic region adjacent to shatterproof1 (SHELL) shell thickness gene
taggaaggaaaaaagatagcacttmcatactgctccatactccttttgtt

SEQ ID NO: 3766 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttcggtttttatcacaagaggaagsaatgaaaagcagtacttttggatgt

SEQ ID NO: 3767 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgtcaagtgtcaagattaaagaaayttttagactatgatgagcatcacct

SEQ ID NO: 3768 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaatggaggggaaaatcatcaatartacacataaagtgttatgatctcca

SEQ ID NO: 3769 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccatttttttcgataaaactatgamacttattcaccgtcgactttattaa

SEQ ID NO: 3770 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatattttacaatttaatatcattracgaaattcaatcattagcctcttt

SEQ ID NO: 3771 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttcatattggcaattgattctttcstgggccaacctgattccccacccaa

SEQ ID NO: 3772 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggccaacctgattccccacccaatwgtttaaaccaattgttgtgccctat

SEQ ID NO: 3773 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctcaaccaatgggctagcaccagcmacagcagtagataatgtcccaaact

SEQ ID NO: 3774 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttaggccattgtttcagagtacacmaatttacacacaagggagcagaatg

SEQ ID NO: 3775 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttcatgaaacatttatatgaagawacggctgtctaggtacaactgaggt

SEQ ID NO: 3776 - DNA, 50 bp, Artificial Sequence
  synthetic Elaeis guineensis (oil palm) single nucleotide polymorphism (SNP) in genomic region adjacent to shatterproof1 (SHELL) shell thickness gene
tggcaaataggccatcacacgactrtggtaggtaggtcgaattaggagat

SEQ ID NO: 3777 - DNA, 50 bp, Artificial Sequence
  synthetic Elaeis guineensis (oil palm) single nucleotide polymorphism (SNP) in genomic region adjacent to shatterproof1 (SHELL) shell thickness gene
cttggtcccaaaattcatggcaaaycatccaaattactattccaatgggc

SEQ ID NO: 3778 - DNA, 50 bp, Artificial Sequence
  synthetic Elaeis guineensis (oil palm) single nucleotide polymorphism (SNP) in genomic region adjacent to shatterproof1 (SHELL) shell thickness gene
catatggcctttcatcattttgagyattttctgtcacctagtatatatta

SEQ ID NO: 3779 - DNA, 50 bp, Artificial Sequence
  synthetic Elaeis guineensis (oil palm) single nucleotide polymorphism (SNP) in genomic region adjacent to shatterproof1 (SHELL) shell thickness gene
caactaatgttatcaaagtttccakgtcaattgccaacatccgtttgtgt

SEQ ID NO: 3780 - DNA, 50 bp, Artificial Sequence
  synthetic Elaeis guineensis (oil palm) single nucleotide polymorphism (SNP) in genomic region adjacent to shatterproof1 (SHELL) shell thickness gene
accgcaatgcagaaagaaagcatayaggtgaattgggtgcacctgcatgt

SEQ ID NO: 3781 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggtgcacctgcatgtcctcatgtgraagatatcattgtccaacaataaaa

SEQ ID NO: 3782 - DNA, 50 bp, Artificial Sequence
  synthetic Elaeis guineensis (oil palm) single nucleotide polymorphism (SNP) in genomic region adjacent to shatterproof1 (SHELL) shell thickness gene
aataataatgcctaatgaacttgtrcattttcatttgctagccctttgga

SEQ ID NO: 3783 - DNA, 50 bp, Artificial Sequence
  synthetic Elaeis guineensis (oil palm) single nucleotide polymorphism (SNP) in genomic region adjacent to shatterproof1 (SHELL) shell thickness gene
catgctgcaaataggaaacgatgaytgaggttctttggagtttagagttg

SEQ ID NO: 3784 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttctgagaatggcagtccttaattygatggcctcatgaatcgaaggtcat

SEQ ID NO: 3785 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatatgtagagagcaaaataatgcyaccatgcttgccattttattgtttc

SEQ ID NO: 3786 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgtgggatggagaatgagattgctkcacaatcttcatcatgacttcacaa

SEQ ID NO: 3787 - DNA, 50 bp, Artificial Sequence
  synthetic Elaeis guineensis (oil palm) single nucleotide polymorphism (SNP) in genomic region adjacent to shatterproof1 (SHELL) shell thickness gene
atgacttcacaaggaaaatctggtkgcatattactgagatattgtcattt

SEQ ID NO: 3788 - DNA, 50 bp, Artificial Sequence
  synthetic Elaeis guineensis (oil palm) single nucleotide polymorphism (SNP) in genomic region adjacent to shatterproof1 (SHELL) shell thickness gene
taatcacagaaacatgctctaatartgattattctatgagctctctattt

SEQ ID NO: 3789 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttgccagcatggcacgtactgtgygatgcattgacatacaacatgcacc

SEQ ID NO: 3790 - DNA, 50 bp, Artificial Sequence
  synthetic Elaeis guineensis (oil palm) single nucleotide polymorphism (SNP) in genomic region adjacent to shatterproof1 (SHELL) shell thickness gene
atttttccaggttttattttttttwaactttgacatttgaacttcgtcct

SEQ ID NO: 3791 - DNA, 50 bp, Artificial Sequence
  synthetic Elaeis guineensis (oil palm) single nucleotide polymorphism (SNP) in genomic region adjacent to shatterproof1 (SHELL) shell thickness gene
gacatttgaacttcgtcctagtccrgttaagagttgctcacaaaattaaa

SEQ ID NO: 3792 - DNA, 50 bp, Artificial Sequence
  synthetic Elaeis guineensis (oil palm) single nucleotide polymorphism (SNP) in genomic region adjacent to shatterproof1 (SHELL) shell thickness gene
caagttaaacttattttgatgaaayttgaaacgttgaccatttctatcaa

SEQ ID NO: 3793 - DNA, 50 bp, Artificial Sequence
  synthetic Elaeis guineensis (oil palm) single nucleotide polymorphism (SNP) in genomic region adjacent to shatterproof1 (SHELL) shell thickness gene
taggaaaagcaacttatcaataacragcataagaggaaagaagttctaac

SEQ ID NO: 3794 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctatttttcaaactcatcatatgmtaaggttgattgatcacatgaccat

SEQ ID NO: 3795 - DNA, 50 bp, Artificial Sequence
  synthetic Elaeis guineensis (oil palm) single nucleotide polymorphism (SNP) in genomic region adjacent to shatterproof1 (SHELL) shell thickness gene
gatcagtgtcaccaaaagaatgtcragttcaaaatttgtgcaggcagata

SEQ ID NO: 3796 - DNA, 50 bp, Artificial Sequence
  synthetic Elaeis guineensis (oil palm) single nucleotide polymorphism (SNP) in genomic region adjacent to shatterproof1 (SHELL) shell thickness gene
taaagagtgggccttggtgcaacartttggttgcttcattatgacatggg

SEQ ID NO: 3797 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagaaaagtaaactaaaggcaaacmacacttatctctatctaaacttaat

SEQ ID NO: 3798 - DNA, 50 bp, Artificial Sequence
  synthetic Elaeis guineensis (oil palm) single nucleotide polymorphism (SNP) in genomic region adjacent to shatterproof1 (SHELL) shell thickness gene
catgtaatcagtatgaatagattaycacaaaatctgaagttttaatgaac

SEQ ID NO: 3799 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttatttgtcagagttatgatgaaascatggaaaatgtagctaaaatttag

SEQ ID NO: 3800 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcagaacacgtaaatgtaggttttkctggatatatttgaaggcaccaagc

SEQ ID NO: 3801 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctttgttcctaatccatctgcaawaatgataaaagtacataactaattc

SEQ ID NO: 3802 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctttgagcacttgcttaccttgccrattaacattacatcaccaataaaat

SEQ ID NO: 3803 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttacattatttaagataagggataraatagccaaattatttgcatatatg

SEQ ID NO: 3804 - DNA, 50 bp, Artificial Sequence
  synthetic Elaeis guineensis (oil palm) single nucleotide polymorphism (SNP) in genomic region adjacent to shatterproof1 (SHELL) shell thickness gene
agcagactaattatcactaatacawcatccaatcattcatatgtccatcc

SEQ ID NO: 3805 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccaaattgtttagtttactctgtcrgcagtaaccctaaaatggtagctca

SEQ ID NO: 3806 - DNA, 50 bp, Artificial Sequence
  synthetic Elaeis guineensis (oil palm) single nucleotide polymorphism (SNP) in genomic region adjacent to shatterproof1 (SHELL) shell thickness gene
attgataagaaacccaactgaaacyggggttccaattgttcaaaattatt

SEQ ID NO: 3807 - DNA, 50 bp, Artificial Sequence
  synthetic Elaeis guineensis (oil palm) single nucleotide polymorphism (SNP) in genomic region adjacent to shatterproof1 (SHELL) shell thickness gene
caactgaaaccggggttccaattgytcaaaattattttcctaatacaaaa

SEQ ID NO: 3808 - DNA, 50 bp, Artificial Sequence
  synthetic Elaeis guineensis (oil palm) single nucleotide polymorphism (SNP) in genomic region adjacent to shatterproof1 (SHELL) shell thickness gene
gatatgttagaggcaacaaatgggyctatttacaccgaattatcatggcc

SEQ ID NO: 3809 - DNA, 50 bp, Artificial Sequence
  synthetic Elaeis guineensis (oil palm) single nucleotide polymorphism (SNP) in genomic region adjacent to shatterproof1 (SHELL) shell thickness gene
taagttccatttttttaaaaaaaayactttagattaaatcaagatgtttg

SEQ ID NO: 3810 - DNA, 50 bp, Artificial Sequence
  synthetic Elaeis guineensis (oil palm) single nucleotide polymorphism (SNP) in genomic region adjacent to shatterproof1 (SHELL) shell thickness gene
taaaaaaaacactttagattaaatmaagatgtttgaggattgaagtcatt

SEQ ID NO: 3811 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaatatatctcttctttctgttttstcgagacatggtctaaaaatcagat

SEQ ID NO: 3812 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagaaggaacaagggaaaaaagaamaaggaggaaagaaaggaagggaaaa

SEQ ID NO: 3813 - DNA, 50 bp, Artificial Sequence
  synthetic Elaeis guineensis (oil palm) single nucleotide polymorphism (SNP) in genomic region adjacent to shatterproof1 (SHELL) shell thickness gene
cgttaaagagatggagggtacctaygggacaggatagaatagcggggcat

SEQ ID NO: 3814 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcccgtaactttcaacaaataaagygaataatatattggtgaaaatgata

SEQ ID NO: 3815 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtaactttcaacaaataaagtgaayaatatattggtgaaaatgatatgag

SEQ ID NO: 3816 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaatgatatgagattgttagttgyccattacagttggtcttggaattga

SEQ ID NO: 3817 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcatgactctatttctgcatttcargagaggaaatgagaggattagatgt

SEQ ID NO: 3818 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttgatttgaagcatacatattttgsgatcatggtgtttgtgggggcttta

SEQ ID NO: 3819 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctttacctatcaaagctacatcccrtgttgattttaagcatacatggttt

SEQ ID NO: 3820 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttaagcatacatggtttggcattayatgttacacatcacagtgtttgtgt

SEQ ID NO: 3821 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtacactttacatatcaaagctacmtactctgttgattgtatgcatactt

SEQ ID NO: 3822 - DNA, 50 bp, Artificial Sequence
  synthetic Elaeis guineensis (oil palm) single nucleotide polymorphism (SNP) in genomic region adjacent to shatterproof1 (SHELL) shell thickness gene
ataataaaaaattaaaccttatcarctagtatgcattatatgttacatat

SEQ ID NO: 3823 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccccgtcacccctctctttaccacrtctctggtccccctctttctcccat

SEQ ID NO: 3824 - DNA, 50 bp, Artificial Sequence
  synthetic Elaeis guineensis (oil palm) single nucleotide polymorphism (SNP) in genomic region adjacent to shatterproof1 (SHELL) shell thickness gene
cgttttctcgagcccccgatcgttsgatcccatctttcagagcccccaac

SEQ ID NO: 3825 - DNA, 50 bp, Artificial Sequence
  synthetic Elaeis guineensis (oil palm) single nucleotide polymorphism (SNP) in genomic region adjacent to shatterproof1 (SHELL) shell thickness gene
acttgcaatgccttattttccaatrgcagatttgagcctttttcttttcc

SEQ ID NO: 3826 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttttattttattttttaaaaaaawtttcaatggattcgggtcaagcttg

SEQ ID NO: 3827 - DNA, 50 bp, Artificial Sequence
  synthetic Elaeis guineensis (oil palm) single nucleotide polymorphism (SNP) in genomic region adjacent to shatterproof1 (SHELL) shell thickness gene
catcacagtaggtaagttaagtagytgagctcgttgtcgctcattcagct

SEQ ID NO: 3828 - DNA, 50 bp, Artificial Sequence
  synthetic Elaeis guineensis (oil palm) single nucleotide polymorphism (SNP) in genomic region adjacent to shatterproof1 (SHELL) shell thickness gene
taattaggtttaagtcagaagaagragatatagaggtcaaaatcaatctt

SEQ ID NO: 3829 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgatgtcggggttgatagggaggtyaacgggctcccactcaaaaagggca

SEQ ID NO: 3830 - DNA, 50 bp, Artificial Sequence
  synthetic Elaeis guineensis (oil palm) single nucleotide polymorphism (SNP) in genomic region adjacent to shatterproof1 (SHELL) shell thickness gene
cgggctcccactcaaaaagggcagkctcgccaacctcgccgacggcagct

SEQ ID NO: 3831 - DNA, 50 bp, Artificial Sequence
  synthetic Elaeis guineensis (oil palm) single nucleotide polymorphism (SNP) in genomic region adjacent to shatterproof1 (SHELL) shell thickness gene
agggccggctcatcggacctcgtcratggtggctgggggccgatgagggg

SEQ ID NO: 3832 - DNA, 50 bp, Artificial Sequence
  synthetic Elaeis guineensis (oil palm) single nucleotide polymorphism (SNP) in genomic region adjacent to shatterproof1 (SHELL) shell thickness gene
catcggacctcgtcgatggtggctrggggccgatgaggggggctagcgcg

SEQ ID NO: 3833 - DNA, 50 bp, Artificial Sequence
  synthetic Elaeis guineensis (oil palm) single nucleotide polymorphism (SNP) in genomic region adjacent to shatterproof1 (SHELL) shell thickness gene
gccagaatatctcagctcagctcgrctcatttttagggctacatgggttg

SEQ ID NO: 3834 - DNA, 50 bp, Artificial Sequence
  synthetic Elaeis guineensis (oil palm) single nucleotide polymorphism (SNP) in genomic region adjacent to shatterproof1 (SHELL) shell thickness gene
caatcgaggagagagctctcaagcygccaactcgcattcttctgcactat

SEQ ID NO: 3835 - DNA, 50 bp, Artificial Sequence
  synthetic Elaeis guineensis (oil palm) single nucleotide polymorphism (SNP) in genomic region adjacent to shatterproof1 (SHELL) shell thickness gene
agagagctctcaagctgccaactcrcattcttctgcactatacgtattac

SEQ ID NO: 3836 - DNA, 50 bp, Artificial Sequence
  synthetic Elaeis guineensis (oil palm) single nucleotide polymorphism (SNP) in genomic region adjacent to shatterproof1 (SHELL) shell thickness gene
gatgtggagtcaccagtgaccccayagtcacacaaagccgcatccgactc

SEQ ID NO: 3837 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaagccgcatccgactctcagagtyagatgcatggtagaggatctgtccg

SEQ ID NO: 3838 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggatctgtccggctcgcggcacctycaactcgatcggaggataaacagct

SEQ ID NO: 3839 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcactttaaagtctaacatttattrttcaaaataaattttgcagcgcatt

SEQ ID NO: 3840 - DNA, 50 bp, Artificial Sequence
  synthetic Elaeis guineensis (oil palm) single nucleotide polymorphism (SNP) in genomic region adjacent to shatterproof1 (SHELL) shell thickness gene
gctagtgaatgagttctccagttarccattgggggctcgtgatgcagcct

SEQ ID NO: 3841 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttctccagttagccattgggggctygtgatgcagccttagagatattcct

SEQ ID NO: 3842 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcgtgatgcagccttagagatattyctgataaatcaaaaatatttaattt

SEQ ID NO: 3843 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccacacatcagtttaaaagaattgrtgattacttagatcctcattctcga

SEQ ID NO: 3844 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctcaatgatccagacgtgggttgasgcacatgatggcagtagcgacaaaa

SEQ ID NO: 3845 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagctaagaggaaataattcaaatwtagaaagagtggagacaatacataa

SEQ ID NO: 3846 - DNA, 50 bp, Artificial Sequence
  synthetic Elaeis guineensis (oil palm) single nucleotide polymorphism (SNP) in genomic region adjacent to shatterproof1 (SHELL) shell thickness gene
aattggccagtttgacgtaattcgrctaaccttgcttatgtatgcaagaa

SEQ ID NO: 3847 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctacttaccagctgcaaatgcaaawttttaaactatgtagaaatgatata

SEQ ID NO: 3848 - DNA, 50 bp, Artificial Sequence
  synthetic Elaeis guineensis (oil palm) single nucleotide polymorphism (SNP) in genomic region adjacent to shatterproof1 (SHELL) shell thickness gene
ataaaattttgaaattgtttgttgygacaattaatgagcattgctttggt

SEQ ID NO: 3849 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatagaaatctctattgataatttkgttcatcaattacaacaatgacctc

SEQ ID NO: 3850 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagaaaaagtttcatgccttatatratttcagcatttatttcttgctctt

SEQ ID NO: 3851 - DNA, 50 bp, Artificial Sequence
  synthetic Elaeis guineensis (oil palm) single nucleotide polymorphism (SNP) in genomic region adjacent to shatterproof1 (SHELL) shell thickness gene
ataaccatagaatatgtgccatatrtgccatcatcatgtttgttttagca

SEQ ID NO: 3852 - DNA, 50 bp, Artificial Sequence
  synthetic Elaeis guineensis (oil palm) single nucleotide polymorphism (SNP) in genomic region adjacent to shatterproof1 (SHELL) shell thickness gene
acatatattattttttatttatttrtcgaggtaaatatatacatcacatt

SEQ ID NO: 3853 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatattattttttatttatttgtcraggtaaatatatacatcacattttc

SEQ ID NO: 3854 - DNA, 50 bp, Artificial Sequence
  synthetic Elaeis guineensis (oil palm) single nucleotide polymorphism (SNP) in genomic region adjacent to shatterproof1 (SHELL) shell thickness gene
cttcatctaataattaaattaagayctgcactctttgattgtcacattat

SEQ ID NO: 3855 - DNA, 50 bp, Artificial Sequence
  synthetic Elaeis guineensis (oil palm) single nucleotide polymorphism (SNP) in genomic region adjacent to shatterproof1 (SHELL) shell thickness gene
attaagacctgcactctttgattgwcacattattattgctttattatagt

SEQ ID NO: 3856 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatcatccttaaaatagctaaaatyttttatgctcgtgggatgtgaacat

SEQ ID NO: 3857 - DNA, 50 bp, Artificial Sequence
  synthetic Elaeis guineensis (oil palm) single nucleotide polymorphism (SNP) in genomic region adjacent to shatterproof1 (SHELL) shell thickness gene
tccatgccgatagaccattccttaratatgaattagaaaaatctttatac

SEQ ID NO: 3858 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgaattagaaaaatctttataccgycgtagaaaagatatgcttccaatta

SEQ ID NO: 3859 - DNA, 50 bp, Artificial Sequence
  synthetic Elaeis guineensis (oil palm) single nucleotide polymorphism (SNP) in genomic region adjacent to shatterproof1 (SHELL) shell thickness gene
aattagaaaaatctttataccgccrtagaaaagatatgcttccaattaag

SEQ ID NO: 3860 - DNA, 50 bp, Artificial Sequence
  synthetic Elaeis guineensis (oil palm) single nucleotide polymorphism (SNP) in genomic region adjacent to shatterproof1 (SHELL) shell thickness gene
atatcaacatatttagtttatcttyatatcgtatcaacatagacaaaatg

SEQ ID NO: 3861 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtggatagaatgttgattgtatgtrtttgatgtgtataatattgaaattc

SEQ ID NO: 3862 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaataaaaatttggtagatgattgraattgtatggatgccagggcgctgg

SEQ ID NO: 3863 - DNA, 50 bp, Artificial Sequence
  synthetic Elaeis guineensis (oil palm) single nucleotide polymorphism (SNP) in genomic region adjacent to shatterproof1 (SHELL) shell thickness gene
acttgaaattatacaattttaagtrgtcgcacccatgttttcaccctttt

SEQ ID NO: 3864 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttaagtagtcgcacccatgttttcmcccttttttatggctctacccacgt

SEQ ID NO: 3865 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttccggatcctgcgatgcgaaagyatattccctcgcatgagtccacggc

SEQ ID NO: 3866 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcgcatgagtccacggctcaccatrttaactccatctccgggtttccaga

SEQ ID NO: 3867 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaccgaaagttccacctagcgtccscatacaacttgtatgcgctctctcc

SEQ ID NO: 3868 - DNA, 50 bp, Artificial Sequence
  synthetic Elaeis guineensis (oil palm) single nucleotide polymorphism (SNP) in genomic region adjacent to shatterproof1 (SHELL) shell thickness gene
cccgacaattataagattcccgagwtggaaaggggaaaggagagagagag

SEQ ID NO: 3869 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttctgtctccgatcccctcccttytcttctggcgttcttttgattctct

SEQ ID NO: 3870 - DNA, 50 bp, Artificial Sequence
  synthetic Elaeis guineensis (oil palm) single nucleotide polymorphism (SNP) in genomic region adjacent to shatterproof1 (SHELL) shell thickness gene
tggatctaattcggtccgatttggwattctatctggaattctaatgaatc

SEQ ID NO: 3871 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttttgaaggatttatatgcagtttsggtgcttaattcgttcttgacatga

SEQ ID NO: 3872 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaagacaggaggtgacaaccatggwggtttttaagaaaaaaatggaatta

SEQ ID NO: 3873 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgcaacaacaatagaattatgcttmgggtttgtttggttggggtatgtca

SEQ ID NO: 3874 - DNA, 50 bp, Artificial Sequence
  synthetic Elaeis guineensis (oil palm) single nucleotide polymorphism (SNP) in genomic region adjacent to shatterproof1 (SHELL) shell thickness gene
atgtcagattacgaggtaatctgaygatttctgaaaattatttatccgga

SEQ ID NO: 3875 - DNA, 50 bp, Artificial Sequence
  synthetic Elaeis guineensis (oil palm) single nucleotide polymorphism (SNP) in genomic region adjacent to shatterproof1 (SHELL) shell thickness gene
atgatttctgaaaattatttatccrgaaaaattattgtggaaaataaaat

SEQ ID NO: 3876 - DNA, 50 bp, Artificial Sequence
  synthetic Elaeis guineensis (oil palm) single nucleotide polymorphism (SNP) in genomic region adjacent to shatterproof1 (SHELL) shell thickness gene
atttaccacatttggatggtggaawactagctctgaaaaatggcattgga

SEQ ID NO: 3877 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttattggaggtaatcttatatcgraatattgtcaaattttcaataatac

SEQ ID NO: 3878 - DNA, 50 bp, Artificial Sequence
  synthetic Elaeis guineensis (oil palm) single nucleotide polymorphism (SNP) in genomic region adjacent to shatterproof1 (SHELL) shell thickness gene
atacctgtaaatggataattcaagkaatagcatttttctcaatccatttg

SEQ ID NO: 3879 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttaatttttttataaattaattakacatatattagagaatatattgtat

SEQ ID NO: 3880 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttattataaataaatttcagtatkctttgtaatataaataaatatatta

SEQ ID NO: 3881 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtataaatatattaatatgttaaayatattattatttatataattattaa

SEQ ID NO: 3882 - DNA, 50 bp, Artificial Sequence
  synthetic Elaeis guineensis (oil palm) single nucleotide polymorphism (SNP) in genomic region adjacent to shatterproof1 (SHELL) shell thickness gene
atgtatttataatattaatataatyaatattaattaaatcatctaattaa

SEQ ID NO: 3883 - DNA, 50 bp, Artificial Sequence
  synthetic Elaeis guineensis (oil palm) single nucleotide polymorphism (SNP) in genomic region adjacent to shatterproof1 (SHELL) shell thickness gene
cataatagattacccccaaccaaargtaccccaagtagaggaataattag

SEQ ID NO: 3884 - DNA, 50 bp, Artificial Sequence
  synthetic Elaeis guineensis (oil palm) single nucleotide polymorphism (SNP) in genomic region adjacent to shatterproof1 (SHELL) shell thickness gene
accccaagtagaggaataattagckaataaggattcataaagctattgtt

SEQ ID NO: 3885 - DNA, 50 bp, Artificial Sequence
  synthetic Elaeis guineensis (oil palm) single nucleotide polymorphism (SNP) in genomic region adjacent to shatterproof1 (SHELL) shell thickness gene
cttttccactaattgaataagtttytcccttttcccccacttctcctacc

SEQ ID NO: 3886 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttttccactaattgaataagttttycccttttcccccacttctcctacct

SEQ ID NO: 3887 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcttttatttaattatttggtttgwtattgtttgcaataaattaagtttg

SEQ ID NO: 3888 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgaattgctttatatggttttcttragattgtgttaagaaggccaatcta

SEQ ID NO: 3889 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatctatagttctcttcttactctrtggtttatatgcagtcttgtggttg

SEQ ID NO: 3890 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttttttaatgcttattctgttggrgtagatattgttatttttgtatgtg

SEQ ID NO: 3891 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttaatgcttattctgttggagtakatattgttatttttgtatgtgtggc

SEQ ID NO: 3892 - DNA, 50 bp, Artificial Sequence
  synthetic Elaeis guineensis (oil palm) single nucleotide polymorphism (SNP) in genomic region adjacent to shatterproof1 (SHELL) shell thickness gene
tataggtaaatgaggaattgttgtyacgactattttctaattaattttgt

SEQ ID NO: 3893 - DNA, 50 bp, Artificial Sequence
  synthetic Elaeis guineensis (oil palm) single nucleotide polymorphism (SNP) in genomic region adjacent to shatterproof1 (SHELL) shell thickness gene
aggtaaatgaggaattgttgtcacractattttctaattaattttgtatt

SEQ ID NO: 3894 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttttgtatttacctttttgccctcracttattattgtttgttcttcttgt

SEQ ID NO: 3895 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctttttatttcatcaattgtaagsatgcatcttgtttatggataaatta

SEQ ID NO: 3896 - DNA, 50 bp, Artificial Sequence
  synthetic Elaeis guineensis (oil palm) single nucleotide polymorphism (SNP) in genomic region adjacent to shatterproof1 (SHELL) shell thickness gene
agtggtattttaatttttttttgcrcagttgagaaatttgtgttatgtga

SEQ ID NO: 3897 - DNA, 50 bp, Artificial Sequence
  synthetic Elaeis guineensis (oil palm) single nucleotide polymorphism (SNP) in genomic region adjacent to shatterproof1 (SHELL) shell thickness gene
atttgtgttatgtgaccatgctacrtttgtgatatcattatatgttgtga

SEQ ID NO: 3898 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttgtgttatgtgaccatgctacgtytgtgatatcattatatgttgtgaat

SEQ ID NO: 3899 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtgatctatcgcattgtacctccayccgagcgatatgaacaagaactgct

SEQ ID NO: 3900 - DNA, 50 bp, Artificial Sequence
  synthetic Elaeis guineensis (oil palm) single nucleotide polymorphism (SNP) in genomic region adjacent to shatterproof1 (SHELL) shell thickness gene
tagtctcttccttgtcaaagacatrttggggttgcatatggatttctgaa

SEQ ID NO: 3901 - DNA, 50 bp, Artificial Sequence
  synthetic Elaeis guineensis (oil palm) single nucleotide polymorphism (SNP) in genomic region adjacent to shatterproof1 (SHELL) shell thickness gene
atttgaatatgaatgtaaatatccrctcttgaatatctaccaggaatcat

SEQ ID NO: 3902 - DNA, 50 bp, Artificial Sequence
  synthetic Elaeis guineensis (oil palm) single nucleotide polymorphism (SNP) in genomic region adjacent to shatterproof1 (SHELL) shell thickness gene
catatttccctcatcttggaccagrtccccatttgtttacaaggcaggtt

SEQ ID NO: 3903 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctttatctcttatttctttaccckttttcctttatttcttttctttcat

SEQ ID NO: 3904 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtcgatcctgtgcggcttcttggtratgatcatggtgatgatttggatag

SEQ ID NO: 3905 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatactgacacaaggagagcggacragggagggggacagggagagtgagg

SEQ ID NO: 3906 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcagatgggaggaaaggtattcatragtgatttctatcagctagattttg

SEQ ID NO: 3907 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcagaacttgttgtggactttaatytcggtgatgtttatttcctcctcat

SEQ ID NO: 3908 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagttagttcttgccatttgtgggrccatgtgggaagaaagaaacaatag

SEQ ID NO: 3909 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatactgttatatttttcttttgcygaacaggtttggagaactttgaagg

SEQ ID NO: 3910 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgacaagaatgaggggactataaaycatatactgttatatttttcttttg

SEQ ID NO: 3911 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttaagggccatggccccctccatcyacccatgtttgctgatgttaacttt

SEQ ID NO: 3912 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagatttgataagaaccacatgaaktctctaaggaatgatctttaaatta

SEQ ID NO: 3913 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccataagagcttgatttatcttggrgagaatgaagggcaggctctgaaag

SEQ ID NO: 3914 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcactctgtggataatacgttattrttctttgaagctgattgtgcacgta

SEQ ID NO: 3915 - DNA, 50 bp, Artificial Sequence
  synthetic Elaeis guineensis (oil palm) single nucleotide polymorphism (SNP) in genomic region adjacent to shatterproof1 (SHELL) shell thickness gene
aggaattagacagggagaccctctwtctccattacactttattctctcct

SEQ ID NO: 3916 - DNA, 50 bp, Artificial Sequence
  synthetic Elaeis guineensis (oil palm) single nucleotide polymorphism (SNP) in genomic region adjacent to shatterproof1 (SHELL) shell thickness gene
ataagatggctgttttagtcaatgygcagcccagaaactagatgaactgt

SEQ ID NO: 3917 - DNA, 50 bp, Artificial Sequence
  synthetic Elaeis guineensis (oil palm) single nucleotide polymorphism (SNP) in genomic region adjacent to shatterproof1 (SHELL) shell thickness gene
aggggatttccttcacagtggattmtggatcaactctagaattaccacaa

SEQ ID NO: 3918 - DNA, 50 bp, Artificial Sequence
  synthetic Elaeis guineensis (oil palm) single nucleotide polymorphism (SNP) in genomic region adjacent to shatterproof1 (SHELL) shell thickness gene
attgcttaccttgcattagtcaccmaaaaagaagctatcagtgcatccaa

SEQ ID NO: 3919 - DNA, 50 bp, Artificial Sequence
  synthetic Elaeis guineensis (oil palm) single nucleotide polymorphism (SNP) in genomic region adjacent to shatterproof1 (SHELL) shell thickness gene
agatttcttgcatctctccaacagmttctttgtaggaaactttgatgcga

SEQ ID NO: 3920 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgctctaggaggggacaagtcaccrgggccggttgaatttcctgtgctat

SEQ ID NO: 3921 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaatttaaaactgtgatctttgctytaggaggggacaagtcaccagggcc

SEQ ID NO: 3922 - DNA, 50 bp, Artificial Sequence
  synthetic Elaeis guineensis (oil palm) single nucleotide polymorphism (SNP) in genomic region adjacent to shatterproof1 (SHELL) shell thickness gene
cagtgtgaaaagaaaatcatttttkgaataatggaaactattgacatact

SEQ ID NO: 3923 - DNA, 50 bp, Artificial Sequence
  synthetic Elaeis guineensis (oil palm) single nucleotide polymorphism (SNP) in genomic region adjacent to shatterproof1 (SHELL) shell thickness gene
aactgcatctttttagaagaactcracatatttagatttgagaagtggtg

SEQ ID NO: 3924 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctgcttttattaggaggcataatmttttggaaacttgtttaaaagaaag

SEQ ID NO: 3925 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaagcaacacagaatagtacagacygtctagagacatttaatttgtgaac

SEQ ID NO: 3926 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcagcatcatttaaattcttattcrgttgtttgaatacatgctagtacag

SEQ ID NO: 3927 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcatctccttattcagcttgacgartgcatgctcctggctttcttgaagt

SEQ ID NO: 3928 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcagtttgtgcggttgatgtatgargagaattgtgaagatatatgggcag

SEQ ID NO: 3929 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaatattttgtggatcagtttgtrcggttgatgtatgaagagaattgtg

SEQ ID NO: 3930 - DNA, 50 bp, Artificial Sequence
  synthetic Elaeis guineensis (oil palm) single nucleotide polymorphism (SNP) in genomic region adjacent to shatterproof1 (SHELL) shell thickness gene
cagaatcttgatgttctgcagactstggaaaattttcttgaatatgtacc

SEQ ID NO: 3931 - DNA, 50 bp, Artificial Sequence
  synthetic Elaeis guineensis (oil palm) single nucleotide polymorphism (SNP) in genomic region adjacent to shatterproof1 (SHELL) shell thickness gene
gccacaaagcctcattacttccagratcttgatgttctgcagactgtgga

SEQ ID NO: 3932 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttatttttcttaaatatataatttratcaataaaaatatttaaattgatg

SEQ ID NO: 3933 - DNA, 50 bp, Artificial Sequence
  synthetic Elaeis guineensis (oil palm) single nucleotide polymorphism (SNP) in genomic region adjacent to shatterproof1 (SHELL) shell thickness gene
taatattgacatattggccaatatsttccaacaatgattgttatttttct

SEQ ID NO: 3934 - DNA, 50 bp, Artificial Sequence
  synthetic Elaeis guineensis (oil palm) single nucleotide polymorphism (SNP) in genomic region adjacent to shatterproof1 (SHELL) shell thickness gene
atagttgtttcatattatttttcgkacgtatctgtaccaaggctttatct

SEQ ID NO: 3935 - DNA, 50 bp, Artificial Sequence
  synthetic Elaeis guineensis (oil palm) single nucleotide polymorphism (SNP) in genomic region adjacent to shatterproof1 (SHELL) shell thickness gene
tagtaaagcccacacccacatggcyacatcctcttctatagttgtttcat

SEQ ID NO: 3936 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaatttcttttcagctcattctcraggacataaagtaataggcattgta

SEQ ID NO: 3937 - DNA, 50 bp, Artificial Sequence
  synthetic Elaeis guineensis (oil palm) single nucleotide polymorphism (SNP) in genomic region adjacent to shatterproof1 (SHELL) shell thickness gene
agttctagagagatcatttctgttrgacaaaaatattttagagaggtacc

SEQ ID NO: 3938 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttacactacaagatgtctttagtrcttgaagaataagtccagctatggc

SEQ ID NO: 3939 - DNA, 50 bp, Artificial Sequence
  synthetic Elaeis guineensis (oil palm) single nucleotide polymorphism (SNP) in genomic region adjacent to shatterproof1 (SHELL) shell thickness gene
cagtatctgttggtttttgtcttcrtatattcattaatgcttttacacta

SEQ ID NO: 3940 - DNA, 50 bp, Artificial Sequence
  synthetic Elaeis guineensis (oil palm) single nucleotide polymorphism (SNP) in genomic region adjacent to shatterproof1 (SHELL) shell thickness gene
agaaatatgtttcttttcttcctamtggtactgtaaatacccagtatctg

SEQ ID NO: 3941 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccaagaaatatgtttcttttcttcytaatggtactgtaaatacccagtat

SEQ ID NO: 3942 - DNA, 50 bp, Artificial Sequence
  synthetic Elaeis guineensis (oil palm) single nucleotide polymorphism (SNP) in genomic region adjacent to shatterproof1 (SHELL) shell thickness gene
agaccagaaaaagctgggcacgttrttgcaaagaaatgctacatgcttga

SEQ ID NO: 3943 - DNA, 50 bp, Artificial Sequence
  synthetic Elaeis guineensis (oil palm) single nucleotide polymorphism (SNP) in genomic region adjacent to shatterproof1 (SHELL) shell thickness gene
agttgtttttagagaaaccagcatmtgatgacagtggggatggaactgct

SEQ ID NO: 3944 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggagatggtgcagttgtttttagasaaaccagcatctgatgacagtgggg

SEQ ID NO: 3945 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccgaaaaatttgttacccttctttycttctttctttttaggaaatcttga

SEQ ID NO: 3946 - DNA, 50 bp, Artificial Sequence
  synthetic Elaeis guineensis (oil palm) single nucleotide polymorphism (SNP) in genomic region adjacent to shatterproof1 (SHELL) shell thickness gene
cggcactcttagttctctactctcmcgaaaaatttgttacccttctttcc

SEQ ID NO: 3947 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaccgaaggccaccggcgatttttsctctcctgcgctgaaggtcgttagg

SEQ ID NO: 3948 - DNA, 50 bp, Artificial Sequence
  synthetic Elaeis guineensis (oil palm) single nucleotide polymorphism (SNP) in genomic region adjacent to shatterproof1 (SHELL) shell thickness gene
cgagccgtttacttcctgagccggrttcgaacatggtcgggtctcgcacc

SEQ ID NO: 3949 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagagctgtgcagaatctgtcatgktagccacaaatatcaaatttcttgt

SEQ ID NO: 3950 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtgatactcaccttcaaacgtattrgtattacttaatttatgcattcctc

SEQ ID NO: 3951 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttggcaacaaaataccttgatagawatgatcaacaattaccatgaaggat

SEQ ID NO: 3952 - DNA, 50 bp, Artificial Sequence
  synthetic Elaeis guineensis (oil palm) single nucleotide polymorphism (SNP) in genomic region adjacent to shatterproof1 (SHELL) shell thickness gene
atctgaagttcatacacgcacacakatctttggcaacaaaataccttgat

SEQ ID NO: 3953 - DNA, 50 bp, Artificial Sequence
  synthetic Elaeis guineensis (oil palm) single nucleotide polymorphism (SNP) in genomic region adjacent to shatterproof1 (SHELL) shell thickness gene
cgagtctaatgggttgctcatggaraagaaacattatctttcactcctaa

SEQ ID NO: 3954 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctggaacggtccttaaactcttggycacctctaaaatttattggttgcat

SEQ ID NO: 3955 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaaaacaagattgggatgccatgtmaattagcaggatagagtttacaaat

SEQ ID NO: 3956 - DNA, 50 bp, Artificial Sequence
  synthetic Elaeis guineensis (oil palm) single nucleotide polymorphism (SNP) in genomic region adjacent to shatterproof1 (SHELL) shell thickness gene
atttttgtacaaaagaatctgtatrctgaaaacaagattgggatgccatg

SEQ ID NO: 3957 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcagcagatgaattacagagcgcaraatgcatgtgcatattgtgcagctt

SEQ ID NO: 3958 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgcttctcaactgtattgtgcaccyaaacacctttggaacagggaaatga

SEQ ID NO: 3959 - DNA, 50 bp, Artificial Sequence
  synthetic Elaeis guineensis (oil palm) single nucleotide polymorphism (SNP) in genomic region adjacent to shatterproof1 (SHELL) shell thickness gene
aattgatactgaaccaagctaagtrgtccacatttcttattgatattctc

SEQ ID NO: 3960 - DNA, 50 bp, Artificial Sequence
  synthetic Elaeis guineensis (oil palm) single nucleotide polymorphism (SNP) in genomic region adjacent to shatterproof1 (SHELL) shell thickness gene
atctaacttgtcacgttttggaccrgtagagtggacaaagctaacaaagc

SEQ ID NO: 3961 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggcttatctcacctttggatttagstttgagatccaactaccatccttga

SEQ ID NO: 3962 - DNA, 50 bp, Artificial Sequence
  synthetic Elaeis guineensis (oil palm) single nucleotide polymorphism (SNP) in genomic region adjacent to shatterproof1 (SHELL) shell thickness gene
cagtatttgttaaggaactgtatarctaaatgttcagtagatgctagatc

SEQ ID NO: 3963 - DNA, 50 bp, Artificial Sequence
  synthetic Elaeis guineensis (oil palm) single nucleotide polymorphism (SNP) in genomic region adjacent to shatterproof1 (SHELL) shell thickness gene
cgtagattttcccagtatttgttarggaactgtataactaaatgttcagt

SEQ ID NO: 3964 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttgatgatgatttgcatgacatcrtagattttcccagtatttgttaagg

SEQ ID NO: 3965 - DNA, 50 bp, Artificial Sequence
  synthetic Elaeis guineensis (oil palm) single nucleotide polymorphism (SNP) in genomic region adjacent to shatterproof1 (SHELL) shell thickness gene
tagatacatatgcaggctcaaacargcacacatgcttggtcgacagccat

SEQ ID NO: 3966 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttcaagataaacatactttgaaatwattgttgtaggcaaagcgacttcct

SEQ ID NO: 3967 - DNA, 50 bp, Artificial Sequence
  synthetic Elaeis guineensis (oil palm) single nucleotide polymorphism (SNP) in genomic region adjacent to shatterproof1 (SHELL) shell thickness gene
attagttgttcggtggaaaaagctmtagaatttctcagatattattctgc

SEQ ID NO: 3968 - DNA, 50 bp, Artificial Sequence
  synthetic Elaeis guineensis (oil palm) single nucleotide polymorphism (SNP) in genomic region adjacent to shatterproof1 (SHELL) shell thickness gene
caggttacaataaaatagaacgagytgtttatgaatatttgtggatgaat

SEQ ID NO: 3969 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggttcccctttcgtcttgtcttctratatttgattatatatctaaaactt

SEQ ID NO: 3970 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgtctctggttcccctttcgtcttktcttctaatatttgattatatatct

SEQ ID NO: 3971 - DNA, 50 bp, Artificial Sequence
  synthetic Elaeis guineensis (oil palm) single nucleotide polymorphism (SNP) in genomic region adjacent to shatterproof1 (SHELL) shell thickness gene
atacatacatgcatacaagtgtatrtctgtgcaggtctgtctctggttcc

SEQ ID NO: 3972 - DNA, 50 bp, Artificial Sequence
  synthetic Elaeis guineensis (oil palm) single nucleotide polymorphism (SNP) in genomic region adjacent to shatterproof1 (SHELL) shell thickness gene
tagaaatagatacatgcattatcakggctattctattatttttatttgtt

SEQ ID NO: 3973 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgacttgtagaaatagatacatgcrttatcagggctattctattattttt

SEQ ID NO: 3974 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggacacttcattttaaggtttctgraagtgttggcagttggcacttttag

SEQ ID NO: 3975 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttaagtctagaaatgttctggtgtrccatgtgaagcagcagatattcttc

SEQ ID NO: 3976 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttctgcagttctgttctgtgcttwagtctagaaatgttctggtgtgcca

SEQ ID NO: 3977 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttgcaaaatatgcatgatttcttyatatgcccctttccactttgttggt

SEQ ID NO: 3978 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttaatctcatctgcgaaaaacatcrtgcagattttgattttggccgatga

SEQ ID NO: 3979 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccgccggcacttggagagtctgccwctagaatcatttgattctgtaagtt

SEQ ID NO: 3980 - DNA, 50 bp, Artificial Sequence
  synthetic Elaeis guineensis (oil palm) single nucleotide polymorphism (SNP) in genomic region adjacent to shatterproof1 (SHELL) shell thickness gene
atgtttaaaaataaagctaaattaytttgactttctattcaagtttcttt

SEQ ID NO: 3981 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcagcgtatcttccaaaagttctcyttgagatcattgtgtttaatttgtt

SEQ ID NO: 3982 - DNA, 50 bp, Artificial Sequence
  synthetic Elaeis guineensis (oil palm) single nucleotide polymorphism (SNP) in genomic region adjacent to shatterproof1 (SHELL) shell thickness gene
cttttattgccattgtatatctttyttctgttccttttttcccatttgat

SEQ ID NO: 3983 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaacaaaattcacccataatatawtatattctttgcataaatgatcatg

SEQ ID NO: 3984 - DNA, 50 bp, Artificial Sequence
  synthetic Elaeis guineensis (oil palm) single nucleotide polymorphism (SNP) in genomic region adjacent to shatterproof1 (SHELL) shell thickness gene
taagatctattatcaagtttgaccmagaaagaaaaataaacagagggcaa

SEQ ID NO: 3985 - DNA, 50 bp, Artificial Sequence
  synthetic Elaeis guineensis (oil palm) single nucleotide polymorphism (SNP) in genomic region adjacent to shatterproof1 (SHELL) shell thickness gene
gttatatgttcatcttttatctatrcattcttatggtcttatattgcata

SEQ ID NO: 3986 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttaaatgcaccactgtaatgggcyattgaagttgcaaatggtgacatgg

SEQ ID NO: 3987 - DNA, 50 bp, Artificial Sequence
  synthetic Elaeis guineensis (oil palm) single nucleotide polymorphism (SNP) in genomic region adjacent to shatterproof1 (SHELL) shell thickness gene
cacaagtatacatattatggcaggktggtttattactaactgttaacaga

SEQ ID NO: 3988 - DNA, 50 bp, Artificial Sequence
  synthetic Elaeis guineensis (oil palm) single nucleotide polymorphism (SNP) in genomic region adjacent to shatterproof1 (SHELL) shell thickness gene
taatctacaatgtgcttacctcacrgatcacaagtatacatattatggca

SEQ ID NO: 3989 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggtttaatattcaagatttccttcyctgggaccttaattgtttattaact

SEQ ID NO: 3990 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcatcaggctattgcatatgctccyattcatccatttgatttccaatgtt

SEQ ID NO: 3991 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgagttttacatcaaaagatggccygagttggatggaatgcaatttgaag

SEQ ID NO: 3992 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgtgagttttacatcaaaagatggyccgagttggatggaatgcaatttga

SEQ ID NO: 3993 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcccctcttctatttttattttgcwatattaatgtttttttttgaacttc

SEQ ID NO: 3994 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttacgttgctggtaaaaaattgackgtaagaataaatttgaagcagaaca

SEQ ID NO: 3995 - DNA, 50 bp, Artificial Sequence
  synthetic Elaeis guineensis (oil palm) single nucleotide polymorphism (SNP) in genomic region adjacent to shatterproof1 (SHELL) shell thickness gene
gttgtggttggatttccttgcattwgctgggtggtcttcctgcttagcta

SEQ ID NO: 3996 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttttcctgtctttttttgacaagmaacttcgtttgtgttttttctttgt

SEQ ID NO: 3997 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggaaatgcggaccaggtactgtttkgggccttttggcaatacctttgaat

SEQ ID NO: 3998 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggtcctagctgaagatggaaatgcrgaccaggtactgttttgggcctttt

SEQ ID NO: 3999 - DNA, 50 bp, Artificial Sequence
  synthetic Elaeis guineensis (oil palm) single nucleotide polymorphism (SNP) in genomic region adjacent to shatterproof1 (SHELL) shell thickness gene
caggaacgatagtttaagattttcrcatctttcttcttaaaagatatgat

SEQ ID NO: 4000 - DNA, 50 bp, Artificial Sequence
  synthetic Elaeis guineensis (oil palm) single nucleotide polymorphism (SNP) in genomic region adjacent to shatterproof1 (SHELL) shell thickness gene
acaagtatctatatgatcgtgtttytatatgtttattatggaatcttttg

SEQ ID NO: 4001 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggatttattttcatatttctgcacragaatagtgaggtggcaatagagga

SEQ ID NO: 4002 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtgcctcgggaaaccacgaccacarctaatgtgccttgcccaagccattt

SEQ ID NO: 4003 - DNA, 50 bp, Artificial Sequence
  synthetic Elaeis guineensis (oil palm) single nucleotide polymorphism (SNP) in genomic region adjacent to shatterproof1 (SHELL) shell thickness gene
accatgaccctaactgatgtgcctygggaaaccacgaccacaactaatgt

SEQ ID NO: 4004 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagtaactaaccaatcaaacatcaytccctcttctttctctcacaaatct

SEQ ID NO: 4005 - DNA, 50 bp, Artificial Sequence
  synthetic Elaeis guineensis (oil palm) single nucleotide polymorphism (SNP) in genomic region adjacent to shatterproof1 (SHELL) shell thickness gene
gagaagcagtagttcagggttcccrtggatgagaaaaatcattgatgtga

SEQ ID NO: 4006 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttcactagaaattgggcgcgcgtgygcgcgcgcacacagagagagagaga

SEQ ID NO: 4007 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatcttactagttcttaaacaatayaccagcattctgaaacaagaaagtt

SEQ ID NO: 4008 - DNA, 50 bp, Artificial Sequence
  synthetic Elaeis guineensis (oil palm) single nucleotide polymorphism (SNP) in genomic region adjacent to shatterproof1 (SHELL) shell thickness gene
attgttatccagtatgaaaaaaaawatatagatgcgaaaatgtatttggt

SEQ ID NO: 4009 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaaatcttgatgttttacttgcatmaatatattgttgtgtttttgtgaac

SEQ ID NO: 4010 - DNA, 50 bp, Artificial Sequence
  synthetic Elaeis guineensis (oil palm) single nucleotide polymorphism (SNP) in genomic region adjacent to shatterproof1 (SHELL) shell thickness gene
gccataacaactgaaatagatatgkcatgatggatcctcatggctttgat

SEQ ID NO: 4011 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgctggattgattaatctcctaacyatgctgagagcatatgatttttcat

SEQ ID NO: 4012 - DNA, 50 bp, Artificial Sequence
  synthetic Elaeis guineensis (oil palm) single nucleotide polymorphism (SNP) in genomic region adjacent to shatterproof1 (SHELL) shell thickness gene
cctccccagccctcggtcggctctmccatttcgatttccatttccatctc

SEQ ID NO: 4013 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatcatcagaatgatgaaaaacttygaattagtgcatgtggaaaggcacg

SEQ ID NO: 4014 - DNA, 50 bp, Artificial Sequence
  synthetic Elaeis guineensis (oil palm) single nucleotide polymorphism (SNP) in genomic region adjacent to shatterproof1 (SHELL) shell thickness gene
catatatggtacttcctttgcccartaatgcgggtgacttatgaaagcct

SEQ ID NO: 4015 - DNA, 50 bp, Artificial Sequence
  synthetic Elaeis guineensis (oil palm) single nucleotide polymorphism (SNP) in genomic region adjacent to shatterproof1 (SHELL) shell thickness gene
taaatattatctaaaaaatacttayctaggaaaatatagattttcagata

SEQ ID NO: 4016 - DNA, 50 bp, Artificial Sequence
  synthetic Elaeis guineensis (oil palm) single nucleotide polymorphism (SNP) in genomic region adjacent to shatterproof1 (SHELL) shell thickness gene
taatgcaaaagaacataggtaacakattttgaagccacttttctatacat

SEQ ID NO: 4017 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttttttaaaactaaaaaacataaargatattatgaaaaatatggataaat

SEQ ID NO: 4018 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgtagagtgtgaatcatattcacasgagttttaatgttcttttggctaaa

SEQ ID NO: 4019 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgcaccaacactgtaatagaatgayactgatacgagatttggtaccgaga

SEQ ID NO: 4020 - DNA, 50 bp, Artificial Sequence
  synthetic Elaeis guineensis (oil palm) single nucleotide polymorphism (SNP) in genomic region adjacent to shatterproof1 (SHELL) shell thickness gene
tccatctccttttgctgagttcttrcatctaaattttcctttcttgtttg

SEQ ID NO: 4021 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttgcaagatgatgttgaagtgtcawggtggggaaaactttaaaaagatta

SEQ ID NO: 4022 - DNA, 50 bp, Artificial Sequence
  synthetic Elaeis guineensis (oil palm) single nucleotide polymorphism (SNP) in genomic region adjacent to shatterproof1 (SHELL) shell thickness gene
tacatcattttctagatcttcctcragtctgtatggtctctcattaagga

SEQ ID NO: 4023 - DNA, 50 bp, Artificial Sequence
  synthetic Elaeis guineensis (oil palm) single nucleotide polymorphism (SNP) in genomic region adjacent to shatterproof1 (SHELL) shell thickness gene
tccaaatctttccattcccacttcrgccgctctcggaacagtgctgcgaa

SEQ ID NO: 4024 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcaacctgatatagggctccaaatytttccattcccacttcagccgctct

SEQ ID NO: 4025 - DNA, 50 bp, Artificial Sequence
  synthetic Elaeis guineensis (oil palm) single nucleotide polymorphism (SNP) in genomic region adjacent to shatterproof1 (SHELL) shell thickness gene
tacttgataagcaaaccttcagagkagaggcccggaacatgcaagtccct

SEQ ID NO: 4026 - DNA, 50 bp, Artificial Sequence
  synthetic Elaeis guineensis (oil palm) single nucleotide polymorphism (SNP) in genomic region adjacent to shatterproof1 (SHELL) shell thickness gene
atacttgataagcaaaccttcagakgagaggcccggaacatgcaagtccc

SEQ ID NO: 4027 - DNA, 50 bp, Artificial Sequence
  synthetic Elaeis guineensis (oil palm) single nucleotide polymorphism (SNP) in genomic region adjacent to shatterproof1 (SHELL) shell thickness gene
caggtttttttttaaaaaaaaatgkactcgaaaacagttacaacagctga

SEQ ID NO: 4028 - DNA, 50 bp, Artificial Sequence
  synthetic Elaeis guineensis (oil palm) single nucleotide polymorphism (SNP) in genomic region adjacent to shatterproof1 (SHELL) shell thickness gene
agagcaacggctaacccgtgcttcmcactagcagtatagccgttacaaga

SEQ ID NO: 4029 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttggaaaatattggtctttggtargcacttgacactacaatctacatgc

SEQ ID NO: 4030 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgttgttacttacccttttatttgsctttcgtttgttcgtgaccatccaa

SEQ ID NO: 4031 - DNA, 50 bp, Artificial Sequence
  synthetic Elaeis guineensis (oil palm) single nucleotide polymorphism (SNP) in genomic region adjacent to shatterproof1 (SHELL) shell thickness gene
gccaccattgttggcacatctataygtgttatatatttcataaggctttt

SEQ ID NO: 4032 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcgaagaaaggtggaggcactcatyaagagggaaagagctctggcctatg

SEQ ID NO: 4033 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttacacctttctattcaacaaaaaraagaagaagaagaagaagaagaaag

SEQ ID NO: 4034 - DNA, 50 bp, Artificial Sequence
  synthetic Elaeis guineensis (oil palm) single nucleotide polymorphism (SNP) in genomic region adjacent to shatterproof1 (SHELL) shell thickness gene
acttttttatttcttgacagcttayagggatggtacctatgtaacgaaat

SEQ ID NO: 4035 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttgggagttgtatggatagatccartattcttgtccaatataactctcaa

SEQ ID NO: 4036 - DNA, 50 bp, Artificial Sequence
  synthetic Elaeis guineensis (oil palm) single nucleotide polymorphism (SNP) in genomic region adjacent to shatterproof1 (SHELL) shell thickness gene
gatgtgaagaggccattttgggagytgtatggatagatccaatattcttg

SEQ ID NO: 4037 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctgacatattctatacattcttcraaatataattacatgcatgctcaca

SEQ ID NO: 4038 - DNA, 50 bp, Artificial Sequence
  synthetic Elaeis guineensis (oil palm) single nucleotide polymorphism (SNP) in genomic region adjacent to shatterproof1 (SHELL) shell thickness gene
cctctttcttttaacatagactcakacttgtgggccttttctagggttta

SEQ ID NO: 4039 - DNA, 50 bp, Artificial Sequence
  synthetic Elaeis guineensis (oil palm) single nucleotide polymorphism (SNP) in genomic region adjacent to shatterproof1 (SHELL) shell thickness gene
actatccaatatagttaattctgascttttaaccctgttttagactttca

SEQ ID NO: 4040 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcttacattggagcttttttaagcrgtgactgaaagtctcatttgcaaca

SEQ ID NO: 4041 - DNA, 50 bp, Artificial Sequence
  synthetic Elaeis guineensis (oil palm) single nucleotide polymorphism (SNP) in genomic region adjacent to shatterproof1 (SHELL) shell thickness gene
gacattcctcaggaggcctacatcsatggaaggttcaactgtaacttact

SEQ ID NO: 4042 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcaaagcttatcaatggtaatgtayatataaatttgcaaagcaaaaagtg

SEQ ID NO: 4043 - DNA, 50 bp, Artificial Sequence
  synthetic Elaeis guineensis (oil palm) single nucleotide polymorphism (SNP) in genomic region adjacent to shatterproof1 (SHELL) shell thickness gene
caagtggatggattaactttggttmggaatgaaaagaactctctgagggt

SEQ ID NO: 4044 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttggagagatgttcagaagcaagtsgatggattaactttggttaggaatg

SEQ ID NO: 4045 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgtctccatctcttcctccagtgcmataggtttagctttggaagtaattc

SEQ ID NO: 4046 - DNA, 50 bp, Artificial Sequence
  synthetic Elaeis guineensis (oil palm) single nucleotide polymorphism (SNP) in genomic region adjacent to shatterproof1 (SHELL) shell thickness gene
cctggttccttgaatgagaaaaaaraaaaaagcatataggatataatttt

SEQ ID NO: 4047 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttctatagcatgtgagtccactacrtactaaaataaccacaccatgtcta

SEQ ID NO: 4048 - DNA, 50 bp, Artificial Sequence
  synthetic Elaeis guineensis (oil palm) single nucleotide polymorphism (SNP) in genomic region adjacent to shatterproof1 (SHELL) shell thickness gene
tacccattaaagggcagacactttrccctttctatagcatgtgagtccac

SEQ ID NO: 4049 - DNA, 50 bp, Artificial Sequence
  synthetic Elaeis guineensis (oil palm) single nucleotide polymorphism (SNP) in genomic region adjacent to shatterproof1 (SHELL) shell thickness gene
tccccccctaagctaaggggtcacyaacaggatgaaagagtagtggatct

SEQ ID NO: 4050 - DNA, 50 bp, Artificial Sequence
  synthetic Elaeis guineensis (oil palm) single nucleotide polymorphism (SNP) in genomic region adjacent to shatterproof1 (SHELL) shell thickness gene
agataatagtttatgcttgaggctwgacaatggagatgatggcctacaag

SEQ ID NO: 4051 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgaggcacctcgcatttagtgccayatttagattttcaaccccaaatctc

SEQ ID NO: 4052 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccagtctcaaattttgaggcacctygcatttagtgccacatttagatttt

SEQ ID NO: 4053 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttgaaatgattgttactacaacasttacactttttaggaagtaaacttg

SEQ ID NO: 4054 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttatttgcaagtagtgttgtaagtwtgtgaaaatttaagaagatttttcc

SEQ ID NO: 4055 - DNA, 50 bp, Artificial Sequence
  synthetic Elaeis guineensis (oil palm) single nucleotide polymorphism (SNP) in genomic region adjacent to shatterproof1 (SHELL) shell thickness gene
tagctttatttgcaagtagtgttgyaagtttgtgaaaatttaagaagatt

SEQ ID NO: 4056 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagaatagctccattgtatgatagytttatttgcaagtagtgttgtaagt

SEQ ID NO: 4057 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaatggtattccagtgtatttttcmaaaaaaagatacaactaatggtaaa

SEQ ID NO: 4058 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggttggcacccttctctttataaakcattacgaaaagcttctggacttga

SEQ ID NO: 4059 - DNA, 50 bp, Artificial Sequence
  synthetic Elaeis guineensis (oil palm) single nucleotide polymorphism (SNP) in genomic region adjacent to shatterproof1 (SHELL) shell thickness gene
atgtagtattactttataataatgyaatattattttataatagtatagta

SEQ ID NO: 4060 - DNA, 50 bp, Artificial Sequence
  synthetic Elaeis guineensis (oil palm) single nucleotide polymorphism (SNP) in genomic region adjacent to shatterproof1 (SHELL) shell thickness gene
atattatcttataatagcataataytgttttacaactacaaagataatta

SEQ ID NO: 4061 - DNA, 50 bp, Artificial Sequence
  synthetic Elaeis guineensis (oil palm) single nucleotide polymorphism (SNP) in genomic region adjacent to shatterproof1 (SHELL) shell thickness gene
gttttacaactacaaagataattaratcatttcatcccatttgagtagtt

SEQ ID NO: 4062 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttaaagcaatctcaggaacttttcwgtgatttttccaagttaccgtagca

SEQ ID NO: 4063 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaacatggatctaaaagtgtacaratataaaaattaattttgaaaacac

SEQ ID NO: 4064 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagaataagcacactttatatgcasgtaattaggtttacttttgcacact

SEQ ID NO: 4065 - DNA, 50 bp, Artificial Sequence
  synthetic Elaeis guineensis (oil palm) single nucleotide polymorphism (SNP) in genomic region adjacent to shatterproof1 (SHELL) shell thickness gene
tagttttattcaatgaactttgtayataatcatatagaggaacattagaa

SEQ ID NO: 4066 - DNA, 50 bp, Artificial Sequence
  synthetic Elaeis guineensis (oil palm) single nucleotide polymorphism (SNP) in genomic region adjacent to shatterproof1 (SHELL) shell thickness gene
acaataaagaacagaaattcttgaygataccgaggcttggcccatcatat

SEQ ID NO: 4067 - DNA, 50 bp, Artificial Sequence
  synthetic Elaeis guineensis (oil palm) single nucleotide polymorphism (SNP) in genomic region adjacent to shatterproof1 (SHELL) shell thickness gene
atccatgattttttgcaaacatagktttgcagaactgcatttgtagcatt

SEQ ID NO: 4068 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttgatcctctttcaaaacaagcaakgaagataaaaaaactagtgcagaat

SEQ ID NO: 4069 - DNA, 50 bp, Artificial Sequence
  synthetic Elaeis guineensis (oil palm) single nucleotide polymorphism (SNP) in genomic region adjacent to shatterproof1 (SHELL) shell thickness gene
atacataggaagcaaagtggacaarggagatgaaaatgaaatgcaaacct

SEQ ID NO: 4070 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcattgcatgctgacacattacatkgagatttgtatccttccgtgcagtg

SEQ ID NO: 4071 - DNA, 50 bp, Artificial Sequence
  synthetic Elaeis guineensis (oil palm) single nucleotide polymorphism (SNP) in genomic region adjacent to shatterproof1 (SHELL) shell thickness gene
aggttgacttggatatagttaaccygatcagcattactaggcagtaggca

SEQ ID NO: 4072 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggtaaacttcacaagatagatctaraacagagatgtacatactcgcagaa

SEQ ID NO: 4073 - DNA, 50 bp, Artificial Sequence
  synthetic Elaeis guineensis (oil palm) single nucleotide polymorphism (SNP) in genomic region adjacent to shatterproof1 (SHELL) shell thickness gene
aattatttagctactaatattcagstgaaaaacttccttactacataatg

SEQ ID NO: 4074 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctagcatgccatgcaaatgcttcrtgatgcactgacataatgtgatcaa

SEQ ID NO: 4075 - DNA, 50 bp, Artificial Sequence
  synthetic Elaeis guineensis (oil palm) single nucleotide polymorphism (SNP) in genomic region adjacent to shatterproof1 (SHELL) shell thickness gene
atatgaaaaataaatttaagtggtwgaaacacatgacaaagtacttaaac

SEQ ID NO: 4076 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtaaaaatcaaggtttgccatctcrataccggaccccgtaccggtaaaat

SEQ ID NO: 4077 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtttgccatctcgataccggacccygtaccggtaaaattctgcttaatgt

SEQ ID NO: 4078 - DNA, 50 bp, Artificial Sequence
  synthetic Elaeis guineensis (oil palm) single nucleotide polymorphism (SNP) in genomic region adjacent to shatterproof1 (SHELL) shell thickness gene
cggtacgtggttcagtacggtacartaatgtcagtacgctccgagatagc

SEQ ID NO: 4079 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcgatacagtattccatggtaaaarctaaaaaacaaaacattacatcact

SEQ ID NO: 4080 - DNA, 50 bp, Artificial Sequence
  synthetic Elaeis guineensis (oil palm) single nucleotide polymorphism (SNP) in genomic region adjacent to shatterproof1 (SHELL) shell thickness gene
gagaagaaactgagataaaaatatyaaaaaaaaggaaaactccccaagca

SEQ ID NO: 4081 - DNA, 50 bp, Artificial Sequence
  synthetic Elaeis guineensis (oil palm) single nucleotide polymorphism (SNP) in genomic region adjacent to shatterproof1 (SHELL) shell thickness gene
tagtcacctaaaccgcttttgttcmccacaagtaattattgcataaggat

SEQ ID NO: 4082 - DNA, 50 bp, Artificial Sequence
  synthetic Elaeis guineensis (oil palm) single nucleotide polymorphism (SNP) in genomic region adjacent to shatterproof1 (SHELL) shell thickness gene
atggataaaaggagtcatgatttgygggctccagatatcaaaatctcttt

SEQ ID NO: 4083 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgaaacaagacatctatataagccyttgactggtaagcaagcagcaacaa

SEQ ID NO: 4084 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccaataagtcaggaagcttaaactwtagccacaggcaagcaatgcatatg

SEQ ID NO: 4085 - DNA, 50 bp, Artificial Sequence
  synthetic Elaeis guineensis (oil palm) single nucleotide polymorphism (SNP) in genomic region adjacent to shatterproof1 (SHELL) shell thickness gene
catagccatcttccttgaattcagygcactaactaaatgaatatcatcaa

SEQ ID NO: 4086 - DNA, 50 bp, Artificial Sequence
  synthetic Elaeis guineensis (oil palm) single nucleotide polymorphism (SNP) in genomic region adjacent to shatterproof1 (SHELL) shell thickness gene
actcagaaaatgctggtcaaatacrctgcagcttattatcttggattgga

SEQ ID NO: 4087 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtgtcagtcctaatcaaaattttgkttatgcattgcccagatagatccct

SEQ ID NO: 4088 - DNA, 50 bp, Artificial Sequence
  synthetic Elaeis guineensis (oil palm) single nucleotide polymorphism (SNP) in genomic region adjacent to shatterproof1 (SHELL) shell thickness gene
atctaatagagagaaaagggatgamactagttaagcggtagactagtgat

SEQ ID NO: 4089 - DNA, 50 bp, Artificial Sequence
  synthetic Elaeis guineensis (oil palm) single nucleotide polymorphism (SNP) in genomic region adjacent to shatterproof1 (SHELL) shell thickness gene
agaggacagcaagaggaggccttgytatatatttcaggagagaaaaggaa

SEQ ID NO: 4090 - DNA, 50 bp, Artificial Sequence
  synthetic Elaeis guineensis (oil palm) single nucleotide polymorphism (SNP) in genomic region adjacent to shatterproof1 (SHELL) shell thickness gene
aggagagaaaaggaaaaggcatcamctttacaaatcaagtcaccttagat

SEQ ID NO: 4091 - DNA, 50 bp, Artificial Sequence
  synthetic Elaeis guineensis (oil palm) single nucleotide polymorphism (SNP) in genomic region adjacent to shatterproof1 (SHELL) shell thickness gene
cacttcttaggctccatttttgggrgagccagaaagtactttctagccct

SEQ ID NO: 4092 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcaataatatattatattatattayattataataatattatgctttgtat

SEQ ID NO: 4093 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtcgaaacttccctttttatcttawaagaaagcctcagaattttcaacca

SEQ ID NO: 4094 - DNA, 50 bp, Artificial Sequence
  synthetic Elaeis guineensis (oil palm) single nucleotide polymorphism (SNP) in genomic region adjacent to shatterproof1 (SHELL) shell thickness gene
tggaaactaaattatctacccatcsaagaattgctgttttctcaaacaaa

SEQ ID NO: 4095 - DNA, 50 bp, Artificial Sequence
  synthetic Elaeis guineensis (oil palm) single nucleotide polymorphism (SNP) in genomic region adjacent to shatterproof1 (SHELL) shell thickness gene
gagagaaagccgacgcccgcggggstctagggtttcttttgggcggcttt

SEQ ID NO: 4096 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtgccatcttttgccggactgggcwtgttctcgctcgtcgttgcgttcga

SEQ ID NO: 4097 - DNA, 50 bp, Artificial Sequence
  synthetic Elaeis guineensis (oil palm) single nucleotide polymorphism (SNP) in genomic region adjacent to shatterproof1 (SHELL) shell thickness gene
atggacccaacgacgttaccaaggrtgactctttcccatgtggcactaat

SEQ ID NO: 4098 - DNA, 50 bp, Artificial Sequence
  synthetic Elaeis guineensis (oil palm) single nucleotide polymorphism (SNP) in genomic region adjacent to shatterproof1 (SHELL) shell thickness gene
cacgtggttcacgaacggttttgcycattctatcacccatggtccctaaa

SEQ ID NO: 4099 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttaaaaagatttattagctgtgatytttaaaaaattgtaagtgttttttt

SEQ ID NO: 4100 - DNA, 50 bp, Artificial Sequence
  synthetic Elaeis guineensis (oil palm) single nucleotide polymorphism (SNP) in genomic region adjacent to shatterproof1 (SHELL) shell thickness gene
taccttctccttttgtcaagatggragggactcaaatcgaaaacactagt

SEQ ID NO: 4101 - DNA, 50 bp, Artificial Sequence
  synthetic Elaeis guineensis (oil palm) single nucleotide polymorphism (SNP) in genomic region adjacent to shatterproof1 (SHELL) shell thickness gene
tattttactaactttaccaactttrttatttagcttcctcaaattgatca

SEQ ID NO: 4102 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtggggggcgatagagactaaaccmacagagaagtgttcaatcatagaaa

SEQ ID NO: 4103 - DNA, 50 bp, Artificial Sequence
  synthetic Elaeis guineensis (oil palm) single nucleotide polymorphism (SNP) in genomic region adjacent to shatterproof1 (SHELL) shell thickness gene
acttaaaaggctcctcagggcatgrcaagaatattattctgcctgccaac

SEQ ID NO: 4104 - DNA, 50 bp, Artificial Sequence
  synthetic Elaeis guineensis (oil palm) single nucleotide polymorphism (SNP) in genomic region adjacent to shatterproof1 (SHELL) shell thickness gene
atcatgttatcacatctttagggtyttatggcttcatgaggatgctgcta

SEQ ID NO: 4105 - DNA, 50 bp, Artificial Sequence
  synthetic Elaeis guineensis (oil palm) single nucleotide polymorphism (SNP) in genomic region adjacent to shatterproof1 (SHELL) shell thickness gene
agcctttacacggatcgcagacccsaagtcagtggccgacatattgttct

SEQ ID NO: 4106 - DNA, 50 bp, Artificial Sequence
  synthetic Elaeis guineensis (oil palm) single nucleotide polymorphism (SNP) in genomic region adjacent to shatterproof1 (SHELL) shell thickness gene
atcgcagacccgaagtcagtggccracatattgttctttaagcttctttt

SEQ ID NO: 4107 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatcccattccgcctgcatattctyttcagcgtagtttgacaaactgaca

SEQ ID NO: 4108 - DNA, 50 bp, Artificial Sequence
  synthetic Elaeis guineensis (oil palm) single nucleotide polymorphism (SNP) in genomic region adjacent to shatterproof1 (SHELL) shell thickness gene
tagaattacttcactaatatccatwtcatctttaggtccacaatatttct

SEQ ID NO: 4109 - DNA, 50 bp, Artificial Sequence
  synthetic Elaeis guineensis (oil palm) single nucleotide polymorphism (SNP) in genomic region adjacent to shatterproof1 (SHELL) shell thickness gene
acctcatgatccttgtcgtggtctwggtaggatattacaccataagcaaa

SEQ ID NO: 4110 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatatatcacaagctatagaacctrtatgacaaccatgatgaattttcat

SEQ ID NO: 4111 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcatcctttttcagttatctttatrttacttggttagttttggaggatgt

SEQ ID NO: 4112 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttatgttacttggttagttttggrggatgtgttttttacttcctacatt

SEQ ID NO: 4113 - DNA, 50 bp, Artificial Sequence
  synthetic Elaeis guineensis (oil palm) single nucleotide polymorphism (SNP) in genomic region adjacent to shatterproof1 (SHELL) shell thickness gene
gatgcaagggctacagtttatagcyctaggtagctagaaccatattgtca

SEQ ID NO: 4114 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtgtgattaagatcagcacctgacytggatgagcatctccttgtttacca

SEQ ID NO: 4115 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgtgattaagatcagcacctgactyggatgagcatctccttgtttaccag

SEQ ID NO: 4116 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtaacatgtgtgcatgacaaatggytctcaagacatccaatatctctgtg

SEQ ID NO: 4117 - DNA, 50 bp, Artificial Sequence
  synthetic Elaeis guineensis (oil palm) single nucleotide polymorphism (SNP) in genomic region adjacent to shatterproof1 (SHELL) shell thickness gene
agaaacattaagtatttattggcaytaaacctataattgttatatctatc

SEQ ID NO: 4118 - DNA, 50 bp, Artificial Sequence
  synthetic Elaeis guineensis (oil palm) single nucleotide polymorphism (SNP) in genomic region adjacent to shatterproof1 (SHELL) shell thickness gene
tataattgttatatctatcacaaamaagaatcttcatgtattcattctac

SEQ ID NO: 4119 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttctacatgcttgtgtaactaggarcatgtaaataaatacattgacagac

SEQ ID NO: 4120 - DNA, 50 bp, Artificial Sequence
  synthetic Elaeis guineensis (oil palm) single nucleotide polymorphism (SNP) in genomic region adjacent to shatterproof1 (SHELL) shell thickness gene
gacaaagatgtccatgcatatgcaygcaggcagtggctacatttatgatg

SEQ ID NO: 4121 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatccctgcacctgaggattccttraacaaagacagtgccttgagcaatc

SEQ ID NO: 4122 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgcacctgaggattccttaaacaargacagtgccttgagcaatctctcag

SEQ ID NO: 4123 - DNA, 50 bp, Artificial Sequence
  synthetic Elaeis guineensis (oil palm) single nucleotide polymorphism (SNP) in genomic region adjacent to shatterproof1 (SHELL) shell thickness gene
cggtggactgcagagttcagtgaaygtattgatagccttctgcgctgagt

SEQ ID NO: 4124 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaccagctcgttttcctctagctyacagtggatattccattctcttgct

SEQ ID NO: 4125 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctagctcacagtggatattccatyctcttgctcgacaaattaaaccttg

SEQ ID NO: 4126 - DNA, 50 bp, Artificial Sequence
  synthetic Elaeis guineensis (oil palm) single nucleotide polymorphism (SNP) in genomic region adjacent to shatterproof1 (SHELL) shell thickness gene
cttgacataatacctccctccaacmgtaaaaaccagaccttttactgaag

SEQ ID NO: 4127 - DNA, 50 bp, Artificial Sequence
  synthetic Elaeis guineensis (oil palm) single nucleotide polymorphism (SNP) in genomic region adjacent to shatterproof1 (SHELL) shell thickness gene
caactagctcaaggtcgaattggaycctgaactttccctatcaaattgga

SEQ ID NO: 4128 - DNA, 50 bp, Artificial Sequence
  synthetic Elaeis guineensis (oil palm) single nucleotide polymorphism (SNP) in genomic region adjacent to shatterproof1 (SHELL) shell thickness gene
gacaacgatgaactagctcgatccmgtccggacccagcgaaaggcccaac

SEQ ID NO: 4129 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcagggttgtctctgccatgctctwgtactggatgttcccctatacatcc

SEQ ID NO: 4130 - DNA, 50 bp, Artificial Sequence
  synthetic Elaeis guineensis (oil palm) single nucleotide polymorphism (SNP) in genomic region adjacent to shatterproof1 (SHELL) shell thickness gene
attgccttgtattgataggaaaaaytaagagctgctgctcaatgatgaaa

SEQ ID NO: 4131 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatggtaatatgctgtcacctcctraattaatcaagcaatacaagtaagg

SEQ ID NO: 4132 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggtggattgcacgccgtcgcgtctycctgtaaatactgggtacttgggtg

SEQ ID NO: 4133 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtgcaccagccttcaagcacaacamcattgccataacatcatgtcaatat

SEQ ID NO: 4134 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtttactaatttagttctcttgatwggcgagatttgttgaattgattaag

SEQ ID NO: 4135 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttccttgttgaaatcggcggaactygctgatctgacacaaaatacttgct

SEQ ID NO: 4136 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggggctccggtgatttatatagaargctgtcaaacagctaattatatagc

SEQ ID NO: 4137 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgagattgtacgatcctaaaattgyggggccattggacatatcattgtgg

SEQ ID NO: 4138 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaatccgaaacgtcaagagacaggycaaaaatatcggagcatccggtgca

SEQ ID NO: 4139 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcaagagacaggccaaaaatatcgragcatccggtgcacagatacaatct

SEQ ID NO: 4140 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatttcggaaaatccagatctaatrgataacatattgcatcttatctatc

SEQ ID NO: 4141 - DNA, 50 bp, Artificial Sequence
  synthetic Elaeis guineensis (oil palm) single nucleotide polymorphism (SNP) in genomic region adjacent to shatterproof1 (SHELL) shell thickness gene
gagttggctggggttgggcagacarcgttaaaggttggcagaggggaaac

SEQ ID NO: 4142 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccagaagttttttatgcaaaatttratcttcaatatgttgtttacatgtt

SEQ ID NO: 4143 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttggtttgtttgcatgaaacaagcrtaagtatgtatgtaatgaacataaa

SEQ ID NO: 4144 - DNA, 50 bp, Artificial Sequence
  synthetic Elaeis guineensis (oil palm) single nucleotide polymorphism (SNP) in genomic region adjacent to shatterproof1 (SHELL) shell thickness gene
tacacactagggactaaaagttacraggaacatggttgggcttgacatga

SEQ ID NO: 4145 - DNA, 50 bp, Artificial Sequence
  synthetic Elaeis guineensis (oil palm) single nucleotide polymorphism (SNP) in genomic region adjacent to shatterproof1 (SHELL) shell thickness gene
cccattttttggtccctttttagcyggagtgctcatatcctaagaattga

SEQ ID NO: 4146 - DNA, 50 bp, Artificial Sequence
  synthetic Elaeis guineensis (oil palm) single nucleotide polymorphism (SNP) in genomic region adjacent to shatterproof1 (SHELL) shell thickness gene
agatcaatatccatgtgacacacartattgtcagcttcaaagattctaaa

SEQ ID NO: 4147 - DNA, 50 bp, Artificial Sequence
  synthetic Elaeis guineensis (oil palm) single nucleotide polymorphism (SNP) in genomic region adjacent to shatterproof1 (SHELL) shell thickness gene
atcaaaagaaagaaagaaaatgacmtttcatcccctaagctatccaaaaa

SEQ ID NO: 4148 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctgtgtgcttgctaaagttgtcgakttaaaaaccacttcccccaccaagc

SEQ ID NO: 4149 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaaaccacttcccccaccaagccscagaaaaggggaaaaatgaaaggaa

SEQ ID NO: 4150 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggcattcaacttgttaaaaataacwtttggaggggaattaattaactatt

SEQ ID NO: 4151 - DNA, 50 bp, Artificial Sequence
  synthetic Elaeis guineensis (oil palm) single nucleotide polymorphism (SNP) in genomic region adjacent to shatterproof1 (SHELL) shell thickness gene
aacaatagtgaatctgactgaggarttggaatccatagatactagtctac

SEQ ID NO: 4152 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatctcacaggcaaggtttaatatwattataacctgtaatataattataa

SEQ ID NO: 4153 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtttctgtgtcatactggattaaascttctgcttacaacacaaagctaat

SEQ ID NO: 4154 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttctgaggctgtgagcagccaggaracaagatttaccaatccatttgatt

SEQ ID NO: 4155 - DNA, 50 bp, Artificial Sequence
  synthetic Elaeis guineensis (oil palm) single nucleotide polymorphism (SNP) in genomic region adjacent to shatterproof1 (SHELL) shell thickness gene
atcatttcagaagttgcacaggccwtgccattcagtacaaggtcaccttg

SEQ ID NO: 4156 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgagaaatctatgggtgaggaagckggaattaaagcagctacaattgaat

SEQ ID NO: 4157 - DNA, 50 bp, Artificial Sequence
  synthetic Elaeis guineensis (oil palm) single nucleotide polymorphism (SNP) in genomic region adjacent to shatterproof1 (SHELL) shell thickness gene
cagcctcccattcataattgagacygttatggtgaatctggccgatataa

SEQ ID NO: 4158 - DNA, 50 bp, Artificial Sequence
  synthetic Elaeis guineensis (oil palm) single nucleotide polymorphism (SNP) in genomic region adjacent to shatterproof1 (SHELL) shell thickness gene
actccatcaatgattaattattggrgtagttgagtatggggactcataca

SEQ ID NO: 4159 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttggggtagttgagtatggggactyatacaaaaaagatgttataggaggt

SEQ ID NO: 4160 - DNA, 50 bp, Artificial Sequence
  synthetic Elaeis guineensis (oil palm) single nucleotide polymorphism (SNP) in genomic region adjacent to shatterproof1 (SHELL) shell thickness gene
agactgcaagtagtggaagatgttraacttagtattttcctgaatagcct

SEQ ID NO: 4161 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttgcaagcacatctacatctatctwgggagacatttaacctttgtggttc

SEQ ID NO: 4162 - DNA, 50 bp, Artificial Sequence
  synthetic Elaeis guineensis (oil palm) single nucleotide polymorphism (SNP) in genomic region adjacent to shatterproof1 (SHELL) shell thickness gene
caggtcatttaagttttcacgtacrgtttttttttcttgaaggaataaga

SEQ ID NO: 4163 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttttcacgtacggtttttttttctkgaaggaataagaaggatatctccat

SEQ ID NO: 4164 - DNA, 50 bp, Artificial Sequence
  synthetic Elaeis guineensis (oil palm) single nucleotide polymorphism (SNP) in genomic region adjacent to shatterproof1 (SHELL) shell thickness gene
atcgcaccgatgctcctccggtgcmgtatggcacggggctctccatgggt

SEQ ID NO: 4165 - DNA, 50 bp, Artificial Sequence
  synthetic Elaeis guineensis (oil palm) single nucleotide polymorphism (SNP) in genomic region adjacent to shatterproof1 (SHELL) shell thickness gene
agtagttccgtaattcccaatgaaycgcaccgatgctcctccggtgccgt

SEQ ID NO: 4166 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagtgatgccaagcacgtcttccayacttagcttcgagcaaccttctacc

SEQ ID NO: 4167 - DNA, 50 bp, Artificial Sequence
  synthetic Elaeis guineensis (oil palm) single nucleotide polymorphism (SNP) in genomic region adjacent to shatterproof1 (SHELL) shell thickness gene
caggatctgtcacaaattgtaataraatgttgatgatcggcaaaatctag

SEQ ID NO: 4168 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaagaaatgaaattctcagagggayggatacgaaagaaacttacatctca

SEQ ID NO: 4169 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaggagagacgagcggtgttcaccrgcaaccttgacatctgtattcatgt

SEQ ID NO: 4170 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctcatcaggtagggatacataggtrgcatgggaagaatcagagaccttaa

SEQ ID NO: 4171 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttgccattcgctgcttgtttcgagrgtgcagagcttgacttactgagcag

SEQ ID NO: 4172 - DNA, 50 bp, Artificial Sequence
  synthetic Elaeis guineensis (oil palm) single nucleotide polymorphism (SNP) in genomic region adjacent to shatterproof1 (SHELL) shell thickness gene
cgaggaacctgcaagtttgaataartgaataaataaagaataagatgttc

SEQ ID NO: 4173 - DNA, 50 bp, Artificial Sequence
  synthetic Elaeis guineensis (oil palm) single nucleotide polymorphism (SNP) in genomic region adjacent to shatterproof1 (SHELL) shell thickness gene
tagagacaaacttgactaagctagmgagattaagattgttagtagcctct

SEQ ID NO: 4174 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgttatatatgtgctatgatgatarttataagctaaaaatagaagataca

SEQ ID NO: 4175 - DNA, 50 bp, Artificial Sequence
  synthetic Elaeis guineensis (oil palm) single nucleotide polymorphism (SNP) in genomic region adjacent to shatterproof1 (SHELL) shell thickness gene
gacagatagtaaaaaaaaatgacayaattgttatgtctttgcctttaaag

SEQ ID NO: 4176 - DNA, 50 bp, Artificial Sequence
  synthetic Elaeis guineensis (oil palm) single nucleotide polymorphism (SNP) in genomic region adjacent to shatterproof1 (SHELL) shell thickness gene
taagaattaatagttttgatatgakagaagagtatgcagaatttattttt

SEQ ID NO: 4177 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgaagcattcgagggtaattagcamgtaccatggatggggaataagaatt

SEQ ID NO: 4178 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgtagacttaaaacgccgggctgcrtccactcctcttaacccacatcctc

SEQ ID NO: 4179 - DNA, 50 bp, Artificial Sequence
  synthetic Elaeis guineensis (oil palm) single nucleotide polymorphism (SNP) in genomic region adjacent to shatterproof1 (SHELL) shell thickness gene
cccaccatccatggacgacttgccmagtctccgtggatgtagacttaaaa

SEQ ID NO: 4180 - DNA, 50 bp, Artificial Sequence
  synthetic Elaeis guineensis (oil palm) single nucleotide polymorphism (SNP) in genomic region adjacent to shatterproof1 (SHELL) shell thickness gene
caccggcgactccgggacccaccayccatggacgacttgcccagtctccg

SEQ ID NO: 4181 - DNA, 50 bp, Artificial Sequence
  synthetic Elaeis guineensis (oil palm) single nucleotide polymorphism (SNP) in genomic region adjacent to shatterproof1 (SHELL) shell thickness gene
acagatgggcgctttggtatccaaycgtggaaatattagtcaccggcgac

SEQ ID NO: 4182 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccttgtaaatgaactgactaacacrgtacctaatgacaaaacaattttgg

SEQ ID NO: 4183 - DNA, 50 bp, Artificial Sequence
  synthetic Elaeis guineensis (oil palm) single nucleotide polymorphism (SNP) in genomic region adjacent to shatterproof1 (SHELL) shell thickness gene
ataatttactgcgagtgtttgctgyagaatggattaaaccgatctatcgt

SEQ ID NO: 4184 - DNA, 50 bp, Artificial Sequence
  synthetic Elaeis guineensis (oil palm) single nucleotide polymorphism (SNP) in genomic region adjacent to shatterproof1 (SHELL) shell thickness gene
attggctcccaccctagcatcagcwgcctacaagatggcactgatttcct

SEQ ID NO: 4185 - DNA, 50 bp, Artificial Sequence
  synthetic Elaeis guineensis (oil palm) single nucleotide polymorphism (SNP) in genomic region adjacent to shatterproof1 (SHELL) shell thickness gene
atgggtgcatataaaaaaatggtamctgaaaatgaaaattgaaactaaac

SEQ ID NO: 4186 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtttgcagggattggttatggtcgyagacacccctactcctcaaaattag

SEQ ID NO: 4187 - DNA, 50 bp, Artificial Sequence
  synthetic Elaeis guineensis (oil palm) single nucleotide polymorphism (SNP) in genomic region adjacent to shatterproof1 (SHELL) shell thickness gene
gagtttgcagggattggttatggtygcagacacccctactcctcaaaatt

SEQ ID NO: 4188 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccggctagcatggattccggttctmgttccgcggtccttgatctaggtca

SEQ ID NO: 4189 - DNA, 50 bp, Artificial Sequence
  synthetic Elaeis guineensis (oil palm) single nucleotide polymorphism (SNP) in genomic region adjacent to shatterproof1 (SHELL) shell thickness gene
taggcaagaacgctacagtgatttmcctgccacacttcaatccctacata

SEQ ID NO: 4190 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttagtgaaaagaattaggcaagaaygctacagtgatttacctgccacact

SEQ ID NO: 4191 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaaacatttgtggcaaattatccrttaatctttagtgaaaagaattagg

SEQ ID NO: 4192 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttaatctgactaccgaaagttgatratgtttaagaaacacaacaatgttg

SEQ ID NO: 4193 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtctttaccaatggatggtaacctrcaggacaagagattctaagttcttc

SEQ ID NO: 4194 - DNA, 50 bp, Artificial Sequence
  synthetic Elaeis guineensis (oil palm) single nucleotide polymorphism (SNP) in genomic region adjacent to shatterproof1 (SHELL) shell thickness gene
caaaaagaagcacgaaggttggagkgtcatgatttcattaagcaaccaag

SEQ ID NO: 4195 - DNA, 50 bp, Artificial Sequence
  synthetic Elaeis guineensis (oil palm) single nucleotide polymorphism (SNP) in genomic region adjacent to shatterproof1 (SHELL) shell thickness gene
cgaaaccttggttagtggacgtctrataaaataaaatcccgtatatactg

SEQ ID NO: 4196 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatgcaagtcaatctggctgtagtytgaaacgactacagaaatccctaga

SEQ ID NO: 4197 - DNA, 50 bp, Artificial Sequence
  synthetic Elaeis guineensis (oil palm) single nucleotide polymorphism (SNP) in genomic region adjacent to shatterproof1 (SHELL) shell thickness gene
cttttccccagataacattggacgyaagttacatataacattgaacattt

SEQ ID NO: 4198 - DNA, 50 bp, Artificial Sequence
  synthetic Elaeis guineensis (oil palm) single nucleotide polymorphism (SNP) in genomic region adjacent to shatterproof1 (SHELL) shell thickness gene
cagagaggtcaaaattaaactctcyagtccaaaattttttaagtttcttt

SEQ ID NO: 4199 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctttatcgtgcatgtcactttcagwaaccttcctccctgatgtttgctag

SEQ ID NO: 4200 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttgtaaggaaaaagatgtaggaatrcgtgaaaacatgcagtcaaggtaca

SEQ ID NO: 4201 - DNA, 50 bp, Artificial Sequence
  synthetic Elaeis guineensis (oil palm) single nucleotide polymorphism (SNP) in genomic region adjacent to shatterproof1 (SHELL) shell thickness gene
acaatggtaggattaataattgaaratattgtaaggaaaaagatgtagga

SEQ ID NO: 4202 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccaacattatatagatggttatatwcggctgtacaggttacatgatgcat

SEQ ID NO: 4203 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttattgctatggatatcatggataygtacagttggtttaggcatcacagt

SEQ ID NO: 4204 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaaaaggaaagaaaggaaggtagargaaaagaaagaaaagaagagagaga

SEQ ID NO: 4205 - DNA, 50 bp, Artificial Sequence
  synthetic Elaeis guineensis (oil palm) single nucleotide polymorphism (SNP) in genomic region adjacent to shatterproof1 (SHELL) shell thickness gene
caccggaagagatgaagaaagaggrtagaaggaaaggaaggagagatgaa

SEQ ID NO: 4206 - DNA, 50 bp, Artificial Sequence
  synthetic Elaeis guineensis (oil palm) single nucleotide polymorphism (SNP) in genomic region adjacent to shatterproof1 (SHELL) shell thickness gene
acccatccacaccggaagagatgargaaagaggatagaaggaaaggaagg

SEQ ID NO: 4207 - DNA, 50 bp, Artificial Sequence
  synthetic Elaeis guineensis (oil palm) single nucleotide polymorphism (SNP) in genomic region adjacent to shatterproof1 (SHELL) shell thickness gene
atcaagcccttcaacatggcccggkacatggctatacacatgggggaatg

SEQ ID NO: 4208 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttttacaaataaaagaacaatatyacattaaataaatcaaaagagaaaa

SEQ ID NO: 4209 - DNA, 50 bp, Artificial Sequence
  synthetic Elaeis guineensis (oil palm) single nucleotide polymorphism (SNP) in genomic region adjacent to shatterproof1 (SHELL) shell thickness gene
atgtgattaagggtgggaaaaatcrgatatgcattgcaaacagtggatag

SEQ ID NO: 4210 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgatgacaaaggatatgtgattaarggtgggaaaaatcagatatgcattg

SEQ ID NO: 4211 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaatgaaaaaaatatgagcaggttkcaaaggatgatatttaacacagatt

SEQ ID NO: 4212 - DNA, 50 bp, Artificial Sequence
  synthetic Elaeis guineensis (oil palm) single nucleotide polymorphism (SNP) in genomic region adjacent to shatterproof1 (SHELL) shell thickness gene
agtgaaattttgcctaggatgccakaagaatgaaaaaaatatgagcaggt

SEQ ID NO: 4213 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctcccacaatcttgaaaaagggggraaaaaaccttggaataatggaacgg

SEQ ID NO: 4214 - DNA, 50 bp, Artificial Sequence
  synthetic Elaeis guineensis (oil palm) single nucleotide polymorphism (SNP) in genomic region adjacent to shatterproof1 (SHELL) shell thickness gene
aataattgggtcaagggggtctctyccacaatcttgaaaaagggggaaaa

SEQ ID NO: 4215 - DNA, 50 bp, Artificial Sequence
  synthetic Elaeis guineensis (oil palm) single nucleotide polymorphism (SNP) in genomic region adjacent to shatterproof1 (SHELL) shell thickness gene
ataaatgtaactctgaggccctttyggtgttaggaggatgaaaccaagtt

SEQ ID NO: 4216 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttagattgcattcaactagggtcygggtttctgggtctcagggatgacc

SEQ ID NO: 4217 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttatcaaatctgtctgagtgattsttcaactctaggtgggaacagtttg

SEQ ID NO: 4218 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccactacatgtggagaggctatttycatgtttcaagcccgtgagaaattt

SEQ ID NO: 4219 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggcagcccagctgcactaggctccygccactgcagggtccggagagggtc

SEQ ID NO: 4220 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttataagatttctgaaaccaggtyaggtttttcaattgaagcagggcag

SEQ ID NO: 4221 - DNA, 50 bp, Artificial Sequence
  synthetic Elaeis guineensis (oil palm) single nucleotide polymorphism (SNP) in genomic region adjacent to shatterproof1 (SHELL) shell thickness gene
attaagaatttacaaaagcatcacrcataccatccccgaaatatatgcca

SEQ ID NO: 4222 - DNA, 50 bp, Artificial Sequence
  synthetic Elaeis guineensis (oil palm) single nucleotide polymorphism (SNP) in genomic region adjacent to shatterproof1 (SHELL) shell thickness gene
attaaggtcaaattgcagagaaccwaaaaacttcaaaaatccttaaatac

SEQ ID NO: 4223 - DNA, 50 bp, Artificial Sequence
  synthetic Elaeis guineensis (oil palm) single nucleotide polymorphism (SNP) in genomic region adjacent to shatterproof1 (SHELL) shell thickness gene
acttctactacataaaagtcagcckgttatggtacactattgatcactag

SEQ ID NO: 4224 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctagcttctagcctccagcaaaargtaagggtttccagctttatcgctt

SEQ ID NO: 4225 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttcctattcaaggttagtaccaaascaacccacaaaaaaggcatggcaca

SEQ ID NO: 4226 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttacgtgctcttcaaagggtaagygtgctaagtcattagcacactaaat

SEQ ID NO: 4227 - DNA, 50 bp, Artificial Sequence
  synthetic Elaeis guineensis (oil palm) single nucleotide polymorphism (SNP) in genomic region adjacent to shatterproof1 (SHELL) shell thickness gene
cccacaccctacgcccgagcccacscccgcaccccaccacctccttctcc

SEQ ID NO: 4228 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgcagaccgatcacccacaccctaygcccgagcccacccccgcaccccac

SEQ ID NO: 4229 - DNA, 50 bp, Artificial Sequence
  synthetic Elaeis guineensis (oil palm) single nucleotide polymorphism (SNP) in genomic region adjacent to shatterproof1 (SHELL) shell thickness gene
gggaacattcctgtgctattctgcracaccaaggcttactcaagatccat

SEQ ID NO: 4230 - DNA, 50 bp, Artificial Sequence
  synthetic Elaeis guineensis (oil palm) single nucleotide polymorphism (SNP) in genomic region adjacent to shatterproof1 (SHELL) shell thickness gene
atcatgaagggctatgtcaatgccwggaattctgtccctgtcctcactgg

SEQ ID NO: 4231 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtgatttccaattctgatctttagraaataaccatgtcaaatgaacaagt

SEQ ID NO: 4232 - DNA, 50 bp, Artificial Sequence
  synthetic Elaeis guineensis (oil palm) single nucleotide polymorphism (SNP) in genomic region adjacent to shatterproof1 (SHELL) shell thickness gene
taagtcatgataagagtagaacaarataagaaaaggaatgagtataactg

SEQ ID NO: 4233 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcagcagatgagtgtcattattggratagaatcggtcattgcaaacaaaa

SEQ ID NO: 4234 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgattctaatattatatgcatgcaycatatttaagtctgtctattatact

SEQ ID NO: 4235 - DNA, 50 bp, Artificial Sequence
  synthetic Elaeis guineensis (oil palm) single nucleotide polymorphism (SNP) in genomic region adjacent to shatterproof1 (SHELL) shell thickness gene
atgattgtgcccgaaataaaatttyggatggagcaataggaagtacagat

SEQ ID NO: 4236 - DNA, 50 bp, Artificial Sequence
  synthetic Elaeis guineensis (oil palm) single nucleotide polymorphism (SNP) in genomic region adjacent to shatterproof1 (SHELL) shell thickness gene
caaatgagtttgaactttgaatgtkgtcagaatcaggagctttgagtttt

SEQ ID NO: 4237 - DNA, 50 bp, Artificial Sequence
  synthetic Elaeis guineensis (oil palm) single nucleotide polymorphism (SNP) in genomic region adjacent to shatterproof1 (SHELL) shell thickness gene
agataccattatataatgactgttrattatccttatataacacctcattg

SEQ ID NO: 4238 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccaaggcttgcgcatcacttgcagyagatgggattttcaagttctgtcgg

SEQ ID NO: 4239 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggaaaaactgatagcaagaaacacyatagtgattatattgacatgatctg

SEQ ID NO: 4240 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccctaaatataactttagaatgttytatcatagcttcatttgctcttcag

SEQ ID NO: 4241 - DNA, 50 bp, Artificial Sequence
  synthetic Elaeis guineensis (oil palm) single nucleotide polymorphism (SNP) in genomic region adjacent to shatterproof1 (SHELL) shell thickness gene
atttgtgaaattgtaatacctttgytcttgctattatttgcaagagcatt

SEQ ID NO: 4242 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttttaaaaaatttgtgaaattgtwatacctttgctcttgctattatttg

SEQ ID NO: 4243 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttattcaagctgacgggaatttcartagtatagaattattgaacgatcaa

SEQ ID NO: 4244 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgtacacaaatttttgaattcaaamaaaatttcttttatttttccacttt

SEQ ID NO: 4245 - DNA, 50 bp, Artificial Sequence
  synthetic Elaeis guineensis (oil palm) single nucleotide polymorphism (SNP) in genomic region adjacent to shatterproof1 (SHELL) shell thickness gene
acacttgtatcactgtaaggtacasttcaaatgtacacaaatttttgaat

SEQ ID NO: 4246 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaaatgaaagtggagatcatgtacmcatgcatgcattagtttcatctgta

SEQ ID NO: 4247 - DNA, 50 bp, Artificial Sequence
  synthetic Elaeis guineensis (oil palm) single nucleotide polymorphism (SNP) in genomic region adjacent to shatterproof1 (SHELL) shell thickness gene
taagttcaagtttcggcaatgaccrtgattttccaactatcagaaatgaa

SEQ ID NO: 4248 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatgtagtttagataataattttarctgtgctctccttttttaataagtt

SEQ ID NO: 4249 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccaatcaaatataaaaagtataaawttttcatccaatgagagggtcaaaa

SEQ ID NO: 4250 - DNA, 50 bp, Artificial Sequence
  synthetic Elaeis guineensis (oil palm) single nucleotide polymorphism (SNP) in genomic region adjacent to shatterproof1 (SHELL) shell thickness gene
acctacagcataaccaaaaaaatgrtgctggtaattgttagatcctttac

SEQ ID NO: 4251 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaccagcaataggattttggcagtkgatgagataaaagttcttccagaca

SEQ ID NO: 4252 - DNA, 50 bp, Artificial Sequence
  synthetic Elaeis guineensis (oil palm) single nucleotide polymorphism (SNP) in genomic region adjacent to shatterproof1 (SHELL) shell thickness gene
atttgatgaagtcaaaaaggatggyggagataaaaggggtttatctagta

SEQ ID NO: 4253 - DNA, 50 bp, Artificial Sequence
  synthetic Elaeis guineensis (oil palm) single nucleotide polymorphism (SNP) in genomic region adjacent to shatterproof1 (SHELL) shell thickness gene
tagctcttttatccttttgtaattkggtggtccacttggagacaggaaga

SEQ ID NO: 4254 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggaagtgccatccatttggcaatgrggtgagacaatgcattggtttcaga

SEQ ID NO: 4255 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagattgatcggctcagctataaamtaaagattgcatttatagtaactat

SEQ ID NO: 4256 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaagttctaaaatgcaagctagcargaataagaaagtaatcacaagtaca

SEQ ID NO: 4257 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctataacattcaaaatcctaaaarccaacaataatctcccgtgaggttt

SEQ ID NO: 4258 - DNA, 50 bp, Artificial Sequence
  synthetic Elaeis guineensis (oil palm) single nucleotide polymorphism (SNP) in genomic region adjacent to shatterproof1 (SHELL) shell thickness gene
cacatgcgtgctgcaagacacatgktaagctatacaaagctatataactt

SEQ ID NO: 4259 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcacccctctatctcacatgcgtgytgcaagacacatgttaagctataca

SEQ ID NO: 4260 - DNA, 50 bp, Artificial Sequence
  synthetic Elaeis guineensis (oil palm) single nucleotide polymorphism (SNP) in genomic region adjacent to shatterproof1 (SHELL) shell thickness gene
gctagctgctttgcctcaccatggytggcaacctgcaagcaaatggctcc

SEQ ID NO: 4261 - DNA, 50 bp, Artificial Sequence
  synthetic Elaeis guineensis (oil palm) single nucleotide polymorphism (SNP) in genomic region adjacent to shatterproof1 (SHELL) shell thickness gene
caaactgaagtgtgtacattccccrttcccacttccctcttcctcttccc

SEQ ID NO: 4262 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatgccatttttagagcatcatgtytattttatatataaaaaaaagatat

SEQ ID NO: 4263 - DNA, 50 bp, Artificial Sequence
  synthetic Elaeis guineensis (oil palm) single nucleotide polymorphism (SNP) in genomic region adjacent to shatterproof1 (SHELL) shell thickness gene
attttgtgttatataggttccctgyttgcatagttctgtcaaattataga

SEQ ID NO: 4264 - DNA, 50 bp, Artificial Sequence
  synthetic Elaeis guineensis (oil palm) single nucleotide polymorphism (SNP) in genomic region adjacent to shatterproof1 (SHELL) shell thickness gene
agtcataaaaaattcaaaaaaaatmgaaggagaagaaaagaaaacaagaa

SEQ ID NO: 4265 - DNA, 50 bp, Artificial Sequence
  synthetic Elaeis guineensis (oil palm) single nucleotide polymorphism (SNP) in genomic region adjacent to shatterproof1 (SHELL) shell thickness gene
gctggctccataaagtttccatttyggcagtttcagtgattttgtaagtt

SEQ ID NO: 4266 - DNA, 50 bp, Artificial Sequence
  synthetic Elaeis guineensis (oil palm) single nucleotide polymorphism (SNP) in genomic region adjacent to shatterproof1 (SHELL) shell thickness gene
atgttgaaatagtaattgcatatgraaattagtggtagcttcaatttgaa

SEQ ID NO: 4267 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaataactataatctgaacaatgaygacactgacaggctgagctggtaaa

SEQ ID NO: 4268 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccttttttttatttaccattatcaytagataagcatgctagaaaaacaaa

SEQ ID NO: 4269 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcaagccctgttacctttatagatrctctccccttaaatctactgtaaca

SEQ ID NO: 4270 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggcatcagcctgaacagttagtcamtttcattttctaaggttgccacatg

SEQ ID NO: 4271 - DNA, 50 bp, Artificial Sequence
  synthetic Elaeis guineensis (oil palm) single nucleotide polymorphism (SNP) in genomic region adjacent to shatterproof1 (SHELL) shell thickness gene
attcctcaaataggacacgctacargcatcagcctgaacagttagtcaat

SEQ ID NO: 4272 - DNA, 50 bp, Artificial Sequence
  synthetic Elaeis guineensis (oil palm) single nucleotide polymorphism (SNP) in genomic region adjacent to shatterproof1 (SHELL) shell thickness gene
cagtcaccttttctggtaggatagraaggccatgagttaattcctcaaat

SEQ ID NO: 4273 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctcataaggaagccaaaagaaagraaaatctattcaaatacgaggttgc

SEQ ID NO: 4274 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaacttgggctgtgttgcttatgayaaggtgtaactcctacattccatct

SEQ ID NO: 4275 - DNA, 50 bp, Artificial Sequence
  synthetic Elaeis guineensis (oil palm) single nucleotide polymorphism (SNP) in genomic region adjacent to shatterproof1 (SHELL) shell thickness gene
catccaataatttctcgccaggccrgggccccacctgatttatttggata

SEQ ID NO: 4276 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttcacttgcgcctggtgcatccaayaatttctcgccaggccagggcccca

SEQ ID NO: 4277 - DNA, 50 bp, Artificial Sequence
  synthetic Elaeis guineensis (oil palm) single nucleotide polymorphism (SNP) in genomic region adjacent to shatterproof1 (SHELL) shell thickness gene
cataccgtgaaactgtttgctgccktctatggcgggcttttgtcaaggca

SEQ ID NO: 4278 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtgtgcgtcgaccataccgtgaaamtgtttgctgccttctatggcgggct

SEQ ID NO: 4279 - DNA, 50 bp, Artificial Sequence
  synthetic Elaeis guineensis (oil palm) single nucleotide polymorphism (SNP) in genomic region adjacent to shatterproof1 (SHELL) shell thickness gene
cgatttatttgaaggcatcggcggygcaaaagccctataacagatctggc

SEQ ID NO: 4280 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttgataagatagtacagaagttgcyatactgtatcaaccttccttgttaa

SEQ ID NO: 4281 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcatttaactgaccaaaaaaaaacmcagtgatggcattttattaaagaaa

SEQ ID NO: 4282 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgttaattgccatgtaatatccttwatcacagggatccgcatcatgtacg

SEQ ID NO: 4283 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctagacagtgagcaaacaaaatgamccaaaaaaaaggtgaatcaaaaaca

SEQ ID NO: 4284 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatcattttgaaagtacaaagcaaraacatttatcctgaatgatttctcc

SEQ ID NO: 4285 - DNA, 50 bp, Artificial Sequence
  synthetic Elaeis guineensis (oil palm) single nucleotide polymorphism (SNP) in genomic region adjacent to shatterproof1 (SHELL) shell thickness gene
acatattcatgggacattggctggkgcacacctagcccatcgccccatct

SEQ ID NO: 4286 - DNA, 50 bp, Artificial Sequence
  synthetic Elaeis guineensis (oil palm) single nucleotide polymorphism (SNP) in genomic region adjacent to shatterproof1 (SHELL) shell thickness gene
acaattacctcaaaataagatgttstcgatgactacattaggcatgagaa

SEQ ID NO: 4287 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcatgcggggataaggttgtgcacrtccagaccccacaatggcgaaagcc

SEQ ID NO: 4288 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcaaaatacgtaaacagcctctccrcatgcggggataaggttgtgcacgt

SEQ ID NO: 4289 - DNA, 50 bp, Artificial Sequence
  synthetic Elaeis guineensis (oil palm) single nucleotide polymorphism (SNP) in genomic region adjacent to shatterproof1 (SHELL) shell thickness gene
cgaaattagttgcctaagaaattcracaggtacttgcaaagctacctatg

SEQ ID NO: 4290 - DNA, 50 bp, Artificial Sequence
  synthetic Elaeis guineensis (oil palm) single nucleotide polymorphism (SNP) in genomic region adjacent to shatterproof1 (SHELL) shell thickness gene
atcttgtttgctgaacagaaagtgyaaacctagttatggcatatctgaag

SEQ ID NO: 4291 - DNA, 50 bp, Artificial Sequence
  synthetic Elaeis guineensis (oil palm) single nucleotide polymorphism (SNP) in genomic region adjacent to shatterproof1 (SHELL) shell thickness gene
attaacgtttaagttggaacaacawtcatatatgtcaccgattatatgtg

SEQ ID NO: 4292 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaacattagacccaagaaccaacygctggtaagttggatgaccaaaaaa

SEQ ID NO: 4293 - DNA, 50 bp, Artificial Sequence
  synthetic Elaeis guineensis (oil palm) single nucleotide polymorphism (SNP) in genomic region adjacent to shatterproof1 (SHELL) shell thickness gene
taccattacaccaggtgtaaaaggwaactggtgataagcaggcaaacaaa

SEQ ID NO: 4294 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcagtatgatccaaaatatgccaaygatcatccaaatataatgtcagcga

SEQ ID NO: 4295 - DNA, 50 bp, Artificial Sequence
  synthetic Elaeis guineensis (oil palm) single nucleotide polymorphism (SNP) in genomic region adjacent to shatterproof1 (SHELL) shell thickness gene
atgttaaggtagcagaacagcattycaaatactaacataaataaggataa

SEQ ID NO: 4296 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgcataatgtaactgaattgcattracctcatcaaacacaaaaagttgca

SEQ ID NO: 4297 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatgtacttagtactttaggcttawgaacatgcagcaggtatagtattta

SEQ ID NO: 4298 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcagactgcctgtaattagaaatcrgacttgaagttttaacttgtagcag

SEQ ID NO: 4299 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaaagcactatcagtcgaagaaccrtccgtcctggacctcttcacatctc

SEQ ID NO: 4300 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctttcctactgccacgcaccgagcrtggcaaacgggagttccacctttgg

SEQ ID NO: 4301 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggatggcggaggaattgccagttgyggtaccacagcattagttgattgct

SEQ ID NO: 4302 - DNA, 50 bp, Artificial Sequence
  synthetic Elaeis guineensis (oil palm) single nucleotide polymorphism (SNP) in genomic region adjacent to shatterproof1 (SHELL) shell thickness gene
attgacctactttgcttcattatgmatcataatatttctactgcttttca

SEQ ID NO: 4303 - DNA, 50 bp, Artificial Sequence
  synthetic Elaeis guineensis (oil palm) single nucleotide polymorphism (SNP) in genomic region adjacent to shatterproof1 (SHELL) shell thickness gene
aattcacaatgaggaatcttgtgcrcccctcattgtcggggataagaata

SEQ ID NO: 4304 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgatttctctattaagatttgacaytgaggcgaccggtttaagcacgtca

SEQ ID NO: 4305 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttcctctatttgatgggattcctcrtatccatcggagattagagcgggaa

SEQ ID NO: 4306 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctctcctcatgacaagcgcataacyttcgcaaacgtgtttgtaaatagcc

SEQ ID NO: 4307 - DNA, 50 bp, Artificial Sequence
  synthetic Elaeis guineensis (oil palm) single nucleotide polymorphism (SNP) in genomic region adjacent to shatterproof1 (SHELL) shell thickness gene
atggcatatcaaaatccaactccarattctaaaattaatatctgcagtac

SEQ ID NO: 4308 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgcctacgatgggaatagttacacyagaaattgttccaatttttgtttgg

SEQ ID NO: 4309 - DNA, 50 bp, Artificial Sequence
  synthetic Elaeis guineensis (oil palm) single nucleotide polymorphism (SNP) in genomic region adjacent to shatterproof1 (SHELL) shell thickness gene
tattaggctggatttggatcgagaraaagataaaaatagcaaaacttatg

SEQ ID NO: 4310 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccattttatgagaaccacttttgcratacaatcttttaaggcaccattgt

SEQ ID NO: 4311 - DNA, 50 bp, Artificial Sequence
  synthetic Elaeis guineensis (oil palm) single nucleotide polymorphism (SNP) in genomic region adjacent to shatterproof1 (SHELL) shell thickness gene
actgattatagctttcctcctcttscctgcctctcctaactcaagttcaa

SEQ ID NO: 4312 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggtaaggttttgcccattaccatawttcttttattcacataactattaat

SEQ ID NO: 4313 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcttccccacagcctcctttgctcrgccaccttatgcatagtggtagctt

SEQ ID NO: 4314 - DNA, 50 bp, Artificial Sequence
  synthetic Elaeis guineensis (oil palm) single nucleotide polymorphism (SNP) in genomic region adjacent to shatterproof1 (SHELL) shell thickness gene
atttggcatggaattgtttcatctrgaaactcgaccttacgaactccact

SEQ ID NO: 4315 - DNA, 50 bp, Artificial Sequence
  synthetic Elaeis guineensis (oil palm) single nucleotide polymorphism (SNP) in genomic region adjacent to shatterproof1 (SHELL) shell thickness gene
tagttgcttccgggtctccttcccytgtccaccttcttgccctttggtgg

SEQ ID NO: 4316 - DNA, 50 bp, Artificial Sequence
  synthetic Elaeis guineensis (oil palm) single nucleotide polymorphism (SNP) in genomic region adjacent to shatterproof1 (SHELL) shell thickness gene
tagattagccttcaagacattgacragtcaaagaaaactcatctgagcac

SEQ ID NO: 4317 - DNA, 50 bp, Artificial Sequence
  synthetic Elaeis guineensis (oil palm) single nucleotide polymorphism (SNP) in genomic region adjacent to shatterproof1 (SHELL) shell thickness gene
gggcatgccattgatgccgatctcracatacatcaaggtcctacctccca

SEQ ID NO: 4318 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaagttgtatcaaggcaagagcacyatattgaactacctcaagaactcca

SEQ ID NO: 4319 - DNA, 50 bp, Artificial Sequence
  synthetic Elaeis guineensis (oil palm) single nucleotide polymorphism (SNP) in genomic region adjacent to shatterproof1 (SHELL) shell thickness gene
tccttgcttgcatcgtaaaaagaarcttggtacctaaattgggtttggtc

SEQ ID NO: 4320 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggttttgcagctcaagccaggcacrgcccataagggcttgggctagcacg

SEQ ID NO: 4321 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtcgaggtagttgtggaataacttsttcattaaggtgctaaatgtagctg

SEQ ID NO: 4322 - DNA, 50 bp, Artificial Sequence
  synthetic Elaeis guineensis (oil palm) single nucleotide polymorphism (SNP) in genomic region adjacent to shatterproof1 (SHELL) shell thickness gene
gccatccaaatacaccactacaaaytcgtcgaggtagttgtggaataact

SEQ ID NO: 4323 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagtgctccacatgctcctccaacrtctagttgtatatgatgatgccatc

SEQ ID NO: 4324 - DNA, 50 bp, Artificial Sequence
  synthetic Elaeis guineensis (oil palm) single nucleotide polymorphism (SNP) in genomic region adjacent to shatterproof1 (SHELL) shell thickness gene
attcaatctcttcccaggcaaaaargcatgtagaaggaaactgcaaaatt

SEQ ID NO: 4325 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtctccacaccctcaagcagtgaaytaccactacattctccttatcatga

SEQ ID NO: 4326 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcaaacattttccaatggtcactcraaaatgaatagtggttctagcaact

SEQ ID NO: 4327 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccattccgattccgattccagaccycccactccccccaaccaagcacccc

SEQ ID NO: 4328 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaaatcggaatagatatcaaaatgrattggaatcagaatcgaaatcagaa

SEQ ID NO: 4329 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggttcgcaaccggaatcaaaatcgraatcggaatagatatcaaaatgaat

SEQ ID NO: 4330 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatgggctccaactggtcgcctcgrtcttctgtagattgtaggagaattg

SEQ ID NO: 4331 - DNA, 50 bp, Artificial Sequence
  synthetic Elaeis guineensis (oil palm) single nucleotide polymorphism (SNP) in genomic region adjacent to shatterproof1 (SHELL) shell thickness gene
attgtgtaacttgcaagtagccttstattgtgagggcaatatttttacaa

SEQ ID NO: 4332 - DNA, 50 bp, Artificial Sequence
  synthetic Elaeis guineensis (oil palm) single nucleotide polymorphism (SNP) in genomic region adjacent to shatterproof1 (SHELL) shell thickness gene
aacaaataaggccattgtgtaactygcaagtagccttctattgtgagggc

SEQ ID NO: 4333 - DNA, 50 bp, Artificial Sequence
  synthetic Elaeis guineensis (oil palm) single nucleotide polymorphism (SNP) in genomic region adjacent to shatterproof1 (SHELL) shell thickness gene
gacgaagctctcttggattcacctmgaccaaggtcatctagctctccata

SEQ ID NO: 4334 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccgctccatcacaccacacagtccrccaatatatattccacctccttgtc

SEQ ID NO: 4335 - DNA, 50 bp, Artificial Sequence
  synthetic Elaeis guineensis (oil palm) single nucleotide polymorphism (SNP) in genomic region adjacent to shatterproof1 (SHELL) shell thickness gene
agtttgaatacatgcaaatgtcacwatttcaacgattaaaatccccctag

SEQ ID NO: 4336 - DNA, 50 bp, Artificial Sequence
  synthetic Elaeis guineensis (oil palm) single nucleotide polymorphism (SNP) in genomic region adjacent to shatterproof1 (SHELL) shell thickness gene
catatcgaaatatttagatgaaaaraaagaaaaccatgaacgttttggga

SEQ ID NO: 4337 - DNA, 50 bp, Artificial Sequence
  synthetic Elaeis guineensis (oil palm) single nucleotide polymorphism (SNP) in genomic region adjacent to shatterproof1 (SHELL) shell thickness gene
tactcaacactcttggcactcatgycaagtgtcttcataacatgaccaca

SEQ ID NO: 4338 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttaactaagaacagtagtcgacaawctaaacttttttacatcccgtcacc

SEQ ID NO: 4339 - DNA, 50 bp, Artificial Sequence
  synthetic Elaeis guineensis (oil palm) single nucleotide polymorphism (SNP) in genomic region adjacent to shatterproof1 (SHELL) shell thickness gene
cagatggaaatcaaagatgaacccscttttgcgcttctgatggtcggtcg

SEQ ID NO: 4340 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaaaaatccctagacgcaaaaatsgcaaccaaactcccgtggaaccaga

SEQ ID NO: 4341 - DNA, 50 bp, Artificial Sequence
  synthetic Elaeis guineensis (oil palm) single nucleotide polymorphism (SNP) in genomic region adjacent to shatterproof1 (SHELL) shell thickness gene
caatccaacgctaacccgcccgggscccagccaggcaagataaaacagcc

SEQ ID NO: 4342 - DNA, 50 bp, Artificial Sequence
  synthetic Elaeis guineensis (oil palm) single nucleotide polymorphism (SNP) in genomic region adjacent to shatterproof1 (SHELL) shell thickness gene
attaaatacgggccaagcccaatcrgtggtgcacccttgtgcaaagaaaa

SEQ ID NO: 4343 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcaaatttatttgcttacgaagcarataaataactattaacttattaggc

SEQ ID NO: 4344 - DNA, 50 bp, Artificial Sequence
  synthetic Elaeis guineensis (oil palm) single nucleotide polymorphism (SNP) in genomic region adjacent to shatterproof1 (SHELL) shell thickness gene
cgaggctttgcctcgaatgtctcgrtatccatggaggtcattgagcctca

SEQ ID NO: 4345 - DNA, 50 bp, Artificial Sequence
  synthetic Elaeis guineensis (oil palm) single nucleotide polymorphism (SNP) in genomic region adjacent to shatterproof1 (SHELL) shell thickness gene
atcgcctagtgggtgagtaggctgrcggcttgagatcggggcaaaatcga

SEQ ID NO: 4346 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgaatcaagattgttagacgtagawatcaactgtggattatgctcatgtt

SEQ ID NO: 4347 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaggcggtggagttgtgcgctctcrtttttgccatcttctcttttttttt

SEQ ID NO: 4348 - DNA, 50 bp, Artificial Sequence
  synthetic Elaeis guineensis (oil palm) single nucleotide polymorphism (SNP) in genomic region adjacent to shatterproof1 (SHELL) shell thickness gene
cactagtcttccttcctcaagctcygataggaaggtgaccggcagagagc

SEQ ID NO: 4349 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttatcccctaccccctaaaaagtyggagatcatattgatgacatcaact

SEQ ID NO: 4350 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgccgactagctatgagaggtcttyagaggattagctccatcgctgtcat

SEQ ID NO: 4351 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctgctcgactcatccctagacaargagcactaagtggccaaagggatcc

SEQ ID NO: 4352 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggatgaggagcactagattgctatrtaatgtcctcgaagagttagcccca

SEQ ID NO: 4353 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatgcggcagctgtcatgatccttrgctcgcaaactcgcatcagggacat

SEQ ID NO: 4354 - DNA, 50 bp, Artificial Sequence
  synthetic Elaeis guineensis (oil palm) single nucleotide polymorphism (SNP) in genomic region adjacent to shatterproof1 (SHELL) shell thickness gene
gatgattgatgagatgctttgtatrcttgtggagaaagtatccatgagta

SEQ ID NO: 4355 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttattttagattgaaattttattraagttaatgtaagatcatttgaata

SEQ ID NO: 4356 - DNA, 50 bp, Artificial Sequence
  synthetic Elaeis guineensis (oil palm) single nucleotide polymorphism (SNP) in genomic region adjacent to shatterproof1 (SHELL) shell thickness gene
aattttgatacttttattttagatkgaaattttattaaagttaatgtaag

SEQ ID NO: 4357 - DNA, 50 bp, Artificial Sequence
  synthetic Elaeis guineensis (oil palm) single nucleotide polymorphism (SNP) in genomic region adjacent to shatterproof1 (SHELL) shell thickness gene
aattaatttcgaactgatgaattakatatgcttattttttataaattatt

SEQ ID NO: 4358 - DNA, 50 bp, Artificial Sequence
  synthetic Elaeis guineensis (oil palm) single nucleotide polymorphism (SNP) in genomic region adjacent to shatterproof1 (SHELL) shell thickness gene
accgcaagatgatacatagcttatrgtaagatgatacgcaatatgatcat

SEQ ID NO: 4359 - DNA, 50 bp, Artificial Sequence
  synthetic Elaeis guineensis (oil palm) single nucleotide polymorphism (SNP) in genomic region adjacent to shatterproof1 (SHELL) shell thickness gene
atcctgtcaattgaggctaatacgwtgacaattattagtccgaaagattt

SEQ ID NO: 4360 - DNA, 50 bp, Artificial Sequence
  synthetic Elaeis guineensis (oil palm) single nucleotide polymorphism (SNP) in genomic region adjacent to shatterproof1 (SHELL) shell thickness gene
gatgacttgaactctctgcttaacyatgtggaggatcctgtcaattgagg

SEQ ID NO: 4361 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccaccatcaatatgcattttcatamttattcatactctttctaatgttgg

SEQ ID NO: 4362 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaacaccttgtcaattagacaacakatttgcattatccaagtcttcatcg

SEQ ID NO: 4363 - DNA, 50 bp, Artificial Sequence
  synthetic Elaeis guineensis (oil palm) single nucleotide polymorphism (SNP) in genomic region adjacent to shatterproof1 (SHELL) shell thickness gene
attgaatcatctgtatggtaattcrgtcatgatttgattaaatcatctga

SEQ ID NO: 4364 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgtggtttctaagcatcatactggyactcatcttagtcagatcatgtacc

SEQ ID NO: 4365 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttgaaacccaccaactctagcctyctatcatcatcgaaaaagttatctt

SEQ ID NO: 4366 - DNA, 50 bp, Artificial Sequence
  synthetic Elaeis guineensis (oil palm) single nucleotide polymorphism (SNP) in genomic region adjacent to shatterproof1 (SHELL) shell thickness gene
cgaggcctttgcacagatattgaarcagcattaaaaaaaatttggccagc

SEQ ID NO: 4367 - DNA, 50 bp, Artificial Sequence
  synthetic Elaeis guineensis (oil palm) single nucleotide polymorphism (SNP) in genomic region adjacent to shatterproof1 (SHELL) shell thickness gene
agtgactattagataaactataccmccctagcctataggagcctaacccc

SEQ ID NO: 4368 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcctagataatttaacatagggtayaaatttattttttcttgatgagtga

SEQ ID NO: 4369 - DNA, 50 bp, Artificial Sequence
  synthetic Elaeis guineensis (oil palm) single nucleotide polymorphism (SNP) in genomic region adjacent to shatterproof1 (SHELL) shell thickness gene
catgatgataaacatgtcattcacyaagaaaaattaataaaataaaataa

SEQ ID NO: 4370 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcatatgattttaaccaatattttygtttctatgttattccttctcatat

SEQ ID NO: 4371 - DNA, 50 bp, Artificial Sequence
  synthetic Elaeis guineensis (oil palm) single nucleotide polymorphism (SNP) in genomic region adjacent to shatterproof1 (SHELL) shell thickness gene
agaggattatttctttttaccaacrtctagatctataatcatatgatttt

SEQ ID NO: 4372 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatcaaaatatagacaattagtgaycaatattctgtgaaaaactaatgta

SEQ ID NO: 4373 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcgtatcaaaatatagacaattagygatcaatattctgtgaaaaactaat

SEQ ID NO: 4374 - DNA, 50 bp, Artificial Sequence
  synthetic Elaeis guineensis (oil palm) single nucleotide polymorphism (SNP) in genomic region adjacent to shatterproof1 (SHELL) shell thickness gene
caaaggtatgttgtgagcgtatcaraatatagacaattagtgatcaatat

SEQ ID NO: 4375 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggttaactgctagagcaatttttaycgacaagatacttttgagaaatgat

SEQ ID NO: 4376 - DNA, 50 bp, Artificial Sequence
  synthetic Elaeis guineensis (oil palm) single nucleotide polymorphism (SNP) in genomic region adjacent to shatterproof1 (SHELL) shell thickness gene
attgaattggcgcattatttaagtrttatcaataaggatttgagtagtaa

SEQ ID NO: 4377 - DNA, 50 bp, Artificial Sequence
  synthetic Elaeis guineensis (oil palm) single nucleotide polymorphism (SNP) in genomic region adjacent to shatterproof1 (SHELL) shell thickness gene
aattttgaaacttgagagattttaytttaaattgaggagatgtctattat

SEQ ID NO: 4378 - DNA, 50 bp, Artificial Sequence
  synthetic Elaeis guineensis (oil palm) single nucleotide polymorphism (SNP) in genomic region adjacent to shatterproof1 (SHELL) shell thickness gene
gatgttcgatagaattttacaattrttaagtataataatttatctcctaa

SEQ ID NO: 4379 - DNA, 50 bp, Artificial Sequence
  synthetic Elaeis guineensis (oil palm) single nucleotide polymorphism (SNP) in genomic region adjacent to shatterproof1 (SHELL) shell thickness gene
atgatatcaataataaaatttttcygcattttgatgttcgatagaatttt

SEQ ID NO: 4380 - DNA, 50 bp, Artificial Sequence
  synthetic Elaeis guineensis (oil palm) single nucleotide polymorphism (SNP) in genomic region adjacent to shatterproof1 (SHELL) shell thickness gene
caccatgctattcctcatcagtcakatatggtaagctatgtaggctattt

SEQ ID NO: 4381 - DNA, 50 bp, Artificial Sequence
  synthetic Elaeis guineensis (oil palm) single nucleotide polymorphism (SNP) in genomic region adjacent to shatterproof1 (SHELL) shell thickness gene
actcgtccgtagggtatccccagtrtgttcagcaacataggcggctatcc

SEQ ID NO: 4382 - DNA, 50 bp, Artificial Sequence
  synthetic Elaeis guineensis (oil palm) single nucleotide polymorphism (SNP) in genomic region adjacent to shatterproof1 (SHELL) shell thickness gene
ataaacatgtgatggataatttaayacatatggtacaaattaatttagct

SEQ ID NO: 4383 - DNA, 50 bp, Artificial Sequence
  synthetic Elaeis guineensis (oil palm) single nucleotide polymorphism (SNP) in genomic region adjacent to shatterproof1 (SHELL) shell thickness gene
actatgatggtaaacatgtcattcrccaagaaaattaataaaataaaata

SEQ ID NO: 4384 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgttaatatgatatttttcaaacartacatgatcaatcctgctgaattta

SEQ ID NO: 4385 - DNA, 50 bp, Artificial Sequence
  synthetic Elaeis guineensis (oil palm) single nucleotide polymorphism (SNP) in genomic region adjacent to shatterproof1 (SHELL) shell thickness gene
attttgatgaattccatttagttayaaatataataggttgctaagcttat

SEQ ID NO: 4386 - DNA, 50 bp, Artificial Sequence
  synthetic Elaeis guineensis (oil palm) single nucleotide polymorphism (SNP) in genomic region adjacent to shatterproof1 (SHELL) shell thickness gene
agcttgaataagaaagttatggtcraaataataaaattgtattaggatat

SEQ ID NO: 4387 - DNA, 50 bp, Artificial Sequence
  synthetic Elaeis guineensis (oil palm) single nucleotide polymorphism (SNP) in genomic region adjacent to shatterproof1 (SHELL) shell thickness gene
aattcgaactacttcaactacatcyacctttaagttaatttctcaaaaca

SEQ ID NO: 4388 - DNA, 50 bp, Artificial Sequence
  synthetic Elaeis guineensis (oil palm) single nucleotide polymorphism (SNP) in genomic region adjacent to shatterproof1 (SHELL) shell thickness gene
cttaaggagagatgggtgagtgctmtttgccaaaagcatttaagaacaaa

SEQ ID NO: 4389 - DNA, 50 bp, Artificial Sequence
  synthetic Elaeis guineensis (oil palm) single nucleotide polymorphism (SNP) in genomic region adjacent to shatterproof1 (SHELL) shell thickness gene
taaatgctagagcaatttttatcgrcatgatgttttttagaaataatctt

SEQ ID NO: 4390 - DNA, 50 bp, Artificial Sequence
  synthetic Elaeis guineensis (oil palm) single nucleotide polymorphism (SNP) in genomic region adjacent to shatterproof1 (SHELL) shell thickness gene
tacttgaaatgaaagttaaatgctrgagcaatttttatcgacatgatgtt

SEQ ID NO: 4391 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatgttggctacttggatagcagtycctctgattgcatcgttctgatatg

SEQ ID NO: 4392 - DNA, 50 bp, Artificial Sequence
  synthetic Elaeis guineensis (oil palm) single nucleotide polymorphism (SNP) in genomic region adjacent to shatterproof1 (SHELL) shell thickness gene
cattattagcgataaattttttgcrtcactaataccctattctgttgtag

SEQ ID NO: 4393 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttcatcgctaataatttttatcgaygaaaattcattattagcgataaatt

SEQ ID NO: 4394 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgattcattgtaaataatcattttrttattagcgatataatattttatca

SEQ ID NO: 4395 - DNA, 50 bp, Artificial Sequence
  synthetic Elaeis guineensis (oil palm) single nucleotide polymorphism (SNP) in genomic region adjacent to shatterproof1 (SHELL) shell thickness gene
agaagagattgaatattatggtgtrctgatagatatcatagaactgaaat

SEQ ID NO: 4396 - DNA, 50 bp, Artificial Sequence
  synthetic Elaeis guineensis (oil palm) single nucleotide polymorphism (SNP) in genomic region adjacent to shatterproof1 (SHELL) shell thickness gene
ataatatagatgctgatgatcaatrtaggagaaaatttgcaaaatgattt

SEQ ID NO: 4397 - DNA, 50 bp, Artificial Sequence
  synthetic Elaeis guineensis (oil palm) single nucleotide polymorphism (SNP) in genomic region adjacent to shatterproof1 (SHELL) shell thickness gene
gttctaaataattgtaaaaaaattraagatttcattgactaagtaccatc

SEQ ID NO: 4398 - DNA, 50 bp, Artificial Sequence
  synthetic Elaeis guineensis (oil palm) single nucleotide polymorphism (SNP) in genomic region adjacent to shatterproof1 (SHELL) shell thickness gene
caatcattcagatcgtaacgcagaycgtgaatgggatgataatgaactga

SEQ ID NO: 4399 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaattgcagaaaatagaaatccaaycggagttgcatttagttcatcgagg

SEQ ID NO: 4400 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaaagtaaaagatagtacaaaagyttatcttgaattgcagaaaatagaa

SEQ ID NO: 4401 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatttgaaaaaatatcgggtacttrcaagcgaaagtgtattgaagctgag

SEQ ID NO: 4402 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttgatggtaagttcgatcgacgtcygccacccaaggagttaagtagagca

SEQ ID NO: 4403 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctagtaatcactcttggaggacccrttacaatcaatactttgatggtaag

SEQ ID NO: 4404 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgatgtatatctacgacagttaatygatgttttgaaggagctatgggaaa

SEQ ID NO: 4405 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcaccttgaaagtacatgaaagaaycatttatttttatatcactattgat

SEQ ID NO: 4406 - DNA, 50 bp, Artificial Sequence
  synthetic Elaeis guineensis (oil palm) single nucleotide polymorphism (SNP) in genomic region adjacent to shatterproof1 (SHELL) shell thickness gene
attgcttcatattaaaatcgtgaaycgatggagtcagaagtcatttgatc

SEQ ID NO: 4407 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtatagacaagaagtatagtcgctrgatatggtatggagagggtcattcg

SEQ ID NO: 4408 - DNA, 50 bp, Artificial Sequence
  synthetic Elaeis guineensis (oil palm) single nucleotide polymorphism (SNP) in genomic region adjacent to shatterproof1 (SHELL) shell thickness gene
atggtatagacaagaagtatagtcrctggatatggtatggagagggtcat

SEQ ID NO: 4409 - DNA, 50 bp, Artificial Sequence
  synthetic Elaeis guineensis (oil palm) single nucleotide polymorphism (SNP) in genomic region adjacent to shatterproof1 (SHELL) shell thickness gene
acagtgctagtcggataaagtatcyatgcaaaagatgtgtcaatatggta

SEQ ID NO: 4410 - DNA, 50 bp, Artificial Sequence
  synthetic Elaeis guineensis (oil palm) single nucleotide polymorphism (SNP) in genomic region adjacent to shatterproof1 (SHELL) shell thickness gene
gttgttagatggatatcaacaaaarttggataaatatcagagatattttt

SEQ ID NO: 4411 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtcgaaataataaaacaatattagratattaaaatatttgataagatgtc

SEQ ID NO: 4412 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttagatttcaaacttgaactacttyaactatatctaactttaacttaatg

SEQ ID NO: 4413 - DNA, 50 bp, Artificial Sequence
  synthetic Elaeis guineensis (oil palm) single nucleotide polymorphism (SNP) in genomic region adjacent to shatterproof1 (SHELL) shell thickness gene
gattttataaatgctagagtaccaygatacacttgaaatgaaggttaaat

SEQ ID NO: 4414 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgcatgtttgtatgttttgggaggrggagagagagttagtgagcgagtgg

SEQ ID NO: 4415 - DNA, 50 bp, Artificial Sequence
  synthetic Elaeis guineensis (oil palm) single nucleotide polymorphism (SNP) in genomic region adjacent to shatterproof1 (SHELL) shell thickness gene
tggcagaattttgcaattgttaggwatgataatttatctcttaaagaatt

SEQ ID NO: 4416 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcctatcttctaatgatgatatcartaataaaatttttctatattttgac

SEQ ID NO: 4417 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccctctagttgcatcgttcctcatrctctaatatatataagcatagtgat

SEQ ID NO: 4418 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcaccatctggactcgaataccacrctatttcttactagtcagatatggt

SEQ ID NO: 4419 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtgaatctcgtcgagcaccatctgractcgaataccacactatttcttac

SEQ ID NO: 4420 - DNA, 50 bp, Artificial Sequence
  synthetic Elaeis guineensis (oil palm) single nucleotide polymorphism (SNP) in genomic region adjacent to shatterproof1 (SHELL) shell thickness gene
tataggtggccatccagtctgccaytgtgttagcctccctgaagacatat

SEQ ID NO: 4421 - DNA, 50 bp, Artificial Sequence
  synthetic Elaeis guineensis (oil palm) single nucleotide polymorphism (SNP) in genomic region adjacent to shatterproof1 (SHELL) shell thickness gene
atttcaaactcgaactactttaacwacatccaactttaagttaatttctt

SEQ ID NO: 4422 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctttgacaatgtgaccacaaactgkggttcctttatatgtgtatatgtag

SEQ ID NO: 4423 - DNA, 50 bp, Artificial Sequence
  synthetic Elaeis guineensis (oil palm) single nucleotide polymorphism (SNP) in genomic region adjacent to shatterproof1 (SHELL) shell thickness gene
aggaggagaattaaaattctcgttrtcgaagtaagcggagagcaagtcat

SEQ ID NO: 4424 - DNA, 50 bp, Artificial Sequence
  synthetic Elaeis guineensis (oil palm) single nucleotide polymorphism (SNP) in genomic region adjacent to shatterproof1 (SHELL) shell thickness gene
cctaggaagactgagattaacatcyagcacctgtttgacacctactaaaa

SEQ ID NO: 4425 - DNA, 50 bp, Artificial Sequence
  synthetic Elaeis guineensis (oil palm) single nucleotide polymorphism (SNP) in genomic region adjacent to shatterproof1 (SHELL) shell thickness gene
caagacacatggatttatgattctktttacctaacaatcatcctaagggc

SEQ ID NO: 4426 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcatgtagtggtgagatgcacaatmaaggaagagtcacaaattgcaaatt

SEQ ID NO: 4427 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttacagataatgatgaagagatatwtgaaaggcatctgataggggtggat

SEQ ID NO: 4428 - DNA, 50 bp, Artificial Sequence
  synthetic Elaeis guineensis (oil palm) single nucleotide polymorphism (SNP) in genomic region adjacent to shatterproof1 (SHELL) shell thickness gene
tggcatattgactttttattcatcractgattatgtgagaaagcataaac

SEQ ID NO: 4429 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgtatctacaaacaagctacaaagyacatcaactagaagaggtgcatgtg

SEQ ID NO: 4430 - DNA, 50 bp, Artificial Sequence
  synthetic Elaeis guineensis (oil palm) single nucleotide polymorphism (SNP) in genomic region adjacent to shatterproof1 (SHELL) shell thickness gene
attagttttctcagtaaatattccwggtaaataaaatcaattcagttgtc

SEQ ID NO: 4431 - DNA, 50 bp, Artificial Sequence
  synthetic Elaeis guineensis (oil palm) single nucleotide polymorphism (SNP) in genomic region adjacent to shatterproof1 (SHELL) shell thickness gene
attgaaatttaacagatcaaatgasaagtgcattgctactagattcttca

SEQ ID NO: 4432 - DNA, 50 bp, Artificial Sequence
  synthetic Elaeis guineensis (oil palm) single nucleotide polymorphism (SNP) in genomic region adjacent to shatterproof1 (SHELL) shell thickness gene
aattggagatccttgaacatatacrgtagcttctaaaacaccactatttt

SEQ ID NO: 4433 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttattgttatctgatgggccctccscccttttgttctgataagtcattgg

SEQ ID NO: 4434 - DNA, 50 bp, Artificial Sequence
  synthetic Elaeis guineensis (oil palm) single nucleotide polymorphism (SNP) in genomic region adjacent to shatterproof1 (SHELL) shell thickness gene
atagtttcaccaagacaaattctgwatcaataaaccaacgatatataatg

SEQ ID NO: 4435 - DNA, 50 bp, Artificial Sequence
  synthetic Elaeis guineensis (oil palm) single nucleotide polymorphism (SNP) in genomic region adjacent to shatterproof1 (SHELL) shell thickness gene
caattatgaaattagaaagttattytctatgcttgaagttctctagtttc

SEQ ID NO: 4436 - DNA, 50 bp, Artificial Sequence
  synthetic Elaeis guineensis (oil palm) single nucleotide polymorphism (SNP) in genomic region adjacent to shatterproof1 (SHELL) shell thickness gene
atgtttgaggaaaacaagtagtcckacaattatgaaattagaaagttatt

SEQ ID NO: 4437 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgtaccaccaagttgcatataactytagagtcaagtctaatctgtatgtt

SEQ ID NO: 4438 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcttgtcctgataatttcctttaasacgttaattccagcaattaactacc

SEQ ID NO: 4439 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcagctcacactcgtcatggtacgwaggtggtgtagaagccttctccaat

SEQ ID NO: 4440 - DNA, 50 bp, Artificial Sequence
  synthetic Elaeis guineensis (oil palm) single nucleotide polymorphism (SNP) in genomic region adjacent to shatterproof1 (SHELL) shell thickness gene
agtcagctcacactcgtcatggtaygaaggtggtgtagaagccttctcca

SEQ ID NO: 4441 - DNA, 50 bp, Artificial Sequence
  synthetic Elaeis guineensis (oil palm) single nucleotide polymorphism (SNP) in genomic region adjacent to shatterproof1 (SHELL) shell thickness gene
atataaatccataacagtttaggaygcagaatactcttgatgcctgggca

SEQ ID NO: 4442 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtctattgcgaaaagtgggtcagtyagatggaattgagaaaacatttgag

SEQ ID NO: 4443 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccaggtcagcctgtctggttgtgtsaatccaaataaaagatttgatgtag

SEQ ID NO: 4444 - DNA, 50 bp, Artificial Sequence
  synthetic Elaeis guineensis (oil palm) single nucleotide polymorphism (SNP) in genomic region adjacent to shatterproof1 (SHELL) shell thickness gene
agcacgtccaggtcagcctgtctgrttgtgtcaatccaaataaaagattt

SEQ ID NO: 4445 - DNA, 50 bp, Artificial Sequence
  synthetic Elaeis guineensis (oil palm) single nucleotide polymorphism (SNP) in genomic region adjacent to shatterproof1 (SHELL) shell thickness gene
taaggtttctgagcttcttgttacwgtttgtatttcatttcctaaaatgg

SEQ ID NO: 4446 - DNA, 50 bp, Artificial Sequence
  synthetic Elaeis guineensis (oil palm) single nucleotide polymorphism (SNP) in genomic region adjacent to shatterproof1 (SHELL) shell thickness gene
gctttagctaattatgctatatatwtttttagattaactgttgattcttg

SEQ ID NO: 4447 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatccagttaccatgtttttgagaygtgctattgtaaaagttgaggaaaa

SEQ ID NO: 4448 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttccattgatgattggtccatcatwcaagattgtctgctcgtgcatatgc

SEQ ID NO: 4449 - DNA, 50 bp, Artificial Sequence
  synthetic Elaeis guineensis (oil palm) single nucleotide polymorphism (SNP) in genomic region adjacent to shatterproof1 (SHELL) shell thickness gene
cagttgggctacattggtcttggcrtagagttttatctccattatactct

SEQ ID NO: 4450 - DNA, 50 bp, Artificial Sequence
  synthetic Elaeis guineensis (oil palm) single nucleotide polymorphism (SNP) in genomic region adjacent to shatterproof1 (SHELL) shell thickness gene
attttgtggatagtgagggatgggraagccactcttgtatgagatttggg

SEQ ID NO: 4451 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgtgctgaggttggaagtcataatkttgcgactgattacgcagtcttggg

SEQ ID NO: 4452 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaaagctgtgttgatttggaaaaawttcctctaaagagattctttttatc

SEQ ID NO: 4453 - DNA, 50 bp, Artificial Sequence
  synthetic Elaeis guineensis (oil palm) single nucleotide polymorphism (SNP) in genomic region adjacent to shatterproof1 (SHELL) shell thickness gene
acctcaatcagccaattcgatttaytgtctggaagataagaatgtgaaag

SEQ ID NO: 4454 - DNA, 50 bp, Artificial Sequence
  synthetic Elaeis guineensis (oil palm) single nucleotide polymorphism (SNP) in genomic region adjacent to shatterproof1 (SHELL) shell thickness gene
tccggacaattttgttggatgagakacttgcacaacagccatatatttag

SEQ ID NO: 4455 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttgttggatgagagacttgcacamcagccatatatttagttatgttgcc

SEQ ID NO: 4456 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagctaaaatagatatttagatcarttaactgctcgcaaccgatggcgaa

SEQ ID NO: 4457 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttagctattgtaggctcaaatttaygggcaagctggggtgcatggcatga

SEQ ID NO: 4458 - DNA, 50 bp, Artificial Sequence
  synthetic Elaeis guineensis (oil palm) single nucleotide polymorphism (SNP) in genomic region adjacent to shatterproof1 (SHELL) shell thickness gene
atgcccatctcctcttggaatttcrtctggcaacgagcattccccaccat

SEQ ID NO: 4459 - DNA, 50 bp, Artificial Sequence
  synthetic Elaeis guineensis (oil palm) single nucleotide polymorphism (SNP) in genomic region adjacent to shatterproof1 (SHELL) shell thickness gene
atcggggtcgcaggtatctgtgtcsgggcacccgcaagcacaggagctgc

SEQ ID NO: 4460 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtccatggttggtggtaagagggtrccattcttacagcaataaggtatct

SEQ ID NO: 4461 - DNA, 50 bp, Artificial Sequence
  synthetic Elaeis guineensis (oil palm) single nucleotide polymorphism (SNP) in genomic region adjacent to shatterproof1 (SHELL) shell thickness gene
gttactcgacttttcaaaactgtgratcttatttaactatacctctagtc

SEQ ID NO: 4462 - DNA, 50 bp, Artificial Sequence
  synthetic Elaeis guineensis (oil palm) single nucleotide polymorphism (SNP) in genomic region adjacent to shatterproof1 (SHELL) shell thickness gene
cttatttaactatacctctagtcaycaaagtggtccacataaaatttgat

SEQ ID NO: 4463 - DNA, 50 bp, Artificial Sequence
  synthetic Elaeis guineensis (oil palm) single nucleotide polymorphism (SNP) in genomic region adjacent to shatterproof1 (SHELL) shell thickness gene
aactatacctctagtcatcaaagtrgtccacataaaatttgatgattctc

SEQ ID NO: 4464 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggtgagcttcacaatatgccatgtrtcccttaatactaatcttaaagtat

SEQ ID NO: 4465 - DNA, 50 bp, Artificial Sequence
  synthetic Elaeis guineensis (oil palm) single nucleotide polymorphism (SNP) in genomic region adjacent to shatterproof1 (SHELL) shell thickness gene
cattttaaagatcttagctcccttmtgtgaagttgaagttggttgattgc

SEQ ID NO: 4466 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctagatccgatccttcttatctcyccaaaatttatctaagttttcacta

SEQ ID NO: 4467 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaaacacatatagtgtatgacttcyacgttattacagattctaattgagt

SEQ ID NO: 4468 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcattatctattgatctctggtttratggtggatcagcattacatgggtt

SEQ ID NO: 4469 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatctgaattactacgtttgatatrtttttttggatggtaatccagatta

SEQ ID NO: 4470 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatatttttttggatggtaatccarattatcttaataatttaattgaaaa

SEQ ID NO: 4471 - DNA, 50 bp, Artificial Sequence
  synthetic Elaeis guineensis (oil palm) single nucleotide polymorphism (SNP) in genomic region adjacent to shatterproof1 (SHELL) shell thickness gene
gctaattatactttcgtcctttgaratttttttattgtatgaaattttta

SEQ ID NO: 4472 - DNA, 50 bp, Artificial Sequence
  synthetic Elaeis guineensis (oil palm) single nucleotide polymorphism (SNP) in genomic region adjacent to shatterproof1 (SHELL) shell thickness gene
caccaagctagtagaccaattaaayttgaaagcaacactaccctagctcc

SEQ ID NO: 4473 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctatatctaatgactaatagtttcraggcatatttttaacaagctcaaga

SEQ ID NO: 4474 - DNA, 50 bp, Artificial Sequence
  synthetic Elaeis guineensis (oil palm) single nucleotide polymorphism (SNP) in genomic region adjacent to shatterproof1 (SHELL) shell thickness gene
cttttgataaaaacttgtaggctcrcaagggcctattaagatgactagta

SEQ ID NO: 4475 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatgttgaaaccgaatatccaccamggcttacataaaaattaaatggcac

SEQ ID NO: 4476 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttgcatcatttgatcattcctacwgtgttctggtgatatccagtggggg

SEQ ID NO: 4477 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctctttgacttcaatctgtgcttcmgagatgaaacgaaaaggtcatcata

SEQ ID NO: 4478 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaaaaggtcatcatattaaacatcmattcttaatctccacctttccaggt

SEQ ID NO: 4479 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttggaggattgctcgccagtagcaygagtacctggaaggaagatcttctt

SEQ ID NO: 4480 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctagacataagagctcaacttactyattaccacatccgaatccgctccat

SEQ ID NO: 4481 - DNA, 50 bp, Artificial Sequence
  synthetic Elaeis guineensis (oil palm) single nucleotide polymorphism (SNP) in genomic region adjacent to shatterproof1 (SHELL) shell thickness gene
aacctggacgaatcatactaatccraaaggctgagatcccatatggatca

SEQ ID NO: 4482 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaatttaacagagactaaagatgmcccaaaacagtggacattgacttga

SEQ ID NO: 4483 - DNA, 50 bp, Artificial Sequence
  synthetic Elaeis guineensis (oil palm) single nucleotide polymorphism (SNP) in genomic region adjacent to shatterproof1 (SHELL) shell thickness gene
attacagccaaaagaagacataccraagcttccagaagcaggtagtggca

SEQ ID NO: 4484 - DNA, 50 bp, Artificial Sequence
  synthetic Elaeis guineensis (oil palm) single nucleotide polymorphism (SNP) in genomic region adjacent to shatterproof1 (SHELL) shell thickness gene
gagcaaaaattcttctacatcaacratctaatggtggtgcaacctggaaa

SEQ ID NO: 4485 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccagaacaaccatttgacaatttaycatgagaaagttatttgctgatctc

SEQ ID NO: 4486 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctcagaaaactctaaagaaagccraatataaattttagacctagattca

SEQ ID NO: 4487 - DNA, 50 bp, Artificial Sequence
  synthetic Elaeis guineensis (oil palm) single nucleotide polymorphism (SNP) in genomic region adjacent to shatterproof1 (SHELL) shell thickness gene
acgtaattcggtcagcaactctgcrcttgtttcagcattgttaggactgg

SEQ ID NO: 4488 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagatttactttgtcaactgggaawatgccatgaacaacatatacacctt

SEQ ID NO: 4489 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttttgttgtagttcaagcatgatgrgatgggtttcaaaatgagtctcaac

SEQ ID NO: 4490 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaggtatgagccattattgagttayaaatgagccacaaatcaaacagatc

SEQ ID NO: 4491 - DNA, 50 bp, Artificial Sequence
  synthetic Elaeis guineensis (oil palm) single nucleotide polymorphism (SNP) in genomic region adjacent to shatterproof1 (SHELL) shell thickness gene
taagcttcatgcatcagctcagatraaggaaccaaggaaaagaatgaaag

SEQ ID NO: 4492 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaacagagctacagttggtagctawgcattatattgtggcaatgaaggaa

SEQ ID NO: 4493 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgcttacaagttgagcctatagcawgaatggatgcaactctactctacca

SEQ ID NO: 4494 - DNA, 50 bp, Artificial Sequence
  synthetic Elaeis guineensis (oil palm) single nucleotide polymorphism (SNP) in genomic region adjacent to shatterproof1 (SHELL) shell thickness gene
attagccgacaaatattaattattmtgagaccggcatataagaagtctaa

SEQ ID NO: 4495 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcagatatggaagactgatccaagwaccgctaaaaccagatcattcgagt

SEQ ID NO: 4496 - DNA, 50 bp, Artificial Sequence
  synthetic Elaeis guineensis (oil palm) single nucleotide polymorphism (SNP) in genomic region adjacent to shatterproof1 (SHELL) shell thickness gene
gatatggaagactgatccaagtacygctaaaaccagatcattcgagtaga

SEQ ID NO: 4497 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtaagtttccgaccactcaccctgmaaaaaggtggcaactttgagatgct

SEQ ID NO: 4498 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctatgcattgacaatatgaaattaytacagatgtgtttcgattaacaatg

SEQ ID NO: 4499 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttatccatccgttgtttggtttgrctttaccatcgagttcatctattct

SEQ ID NO: 4500 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttgaaaagcaaaaataaggcactcrgacatgataataatattatcattta

SEQ ID NO: 4501 - DNA, 50 bp, Artificial Sequence
  synthetic Elaeis guineensis (oil palm) single nucleotide polymorphism (SNP) in genomic region adjacent to shatterproof1 (SHELL) shell thickness gene
acgaacaagcaccgatagatatttkagtgtaaacatgctcatgtcatgtt

SEQ ID NO: 4502 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttgttttgtgggagaaaaggctttscatctgagcctgacctttcatctgc

SEQ ID NO: 4503 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctttgcctttatccttggatttcwgctctacttaaatggtcttactaga

SEQ ID NO: 4504 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgtaatatatttctattgccccccrtgtatttgttacatgatggacaaat

SEQ ID NO: 4505 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaacactgaaaattaaatcccaagyagaccgttagcatctactggatatc

SEQ ID NO: 4506 - DNA, 50 bp, Artificial Sequence
  synthetic Elaeis guineensis (oil palm) single nucleotide polymorphism (SNP) in genomic region adjacent to shatterproof1 (SHELL) shell thickness gene
gatagtatacatctttttccatatwcctaataattaaatgaacatttctc

SEQ ID NO: 4507 - DNA, 50 bp, Artificial Sequence
  synthetic Elaeis guineensis (oil palm) single nucleotide polymorphism (SNP) in genomic region adjacent to shatterproof1 (SHELL) shell thickness gene
acacagtctttatattctttcctgstcattactctgttatatttctttac

SEQ ID NO: 4508 - DNA, 50 bp, Artificial Sequence
  synthetic Elaeis guineensis (oil palm) single nucleotide polymorphism (SNP) in genomic region adjacent to shatterproof1 (SHELL) shell thickness gene
taatgttaaatcccatatctgtgaracttgttatgacaacaatcgaaccc

SEQ ID NO: 4509 - DNA, 50 bp, Artificial Sequence
  synthetic Elaeis guineensis (oil palm) single nucleotide polymorphism (SNP) in genomic region adjacent to shatterproof1 (SHELL) shell thickness gene
acaccatcagttgcaaaactgaaaraaattgagtaaccattgagggttag

SEQ ID NO: 4510 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatctttgtcgctgccttgggatgytttagcacgaatccttcgtccatca

SEQ ID NO: 4511 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgccttgggatgttttagcacgaayccttcgtccatcaagaatagcatgg

SEQ ID NO: 4512 - DNA, 50 bp, Artificial Sequence
  synthetic Elaeis guineensis (oil palm) single nucleotide polymorphism (SNP) in genomic region adjacent to shatterproof1 (SHELL) shell thickness gene
taaataaccagacatccaagaaaayagaaatctcttcaaacccatccaaa

SEQ ID NO: 4513 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttataaaaaatttatatccatatcygattggatcggatgaaatttattta

SEQ ID NO: 4514 - DNA, 50 bp, Artificial Sequence
  synthetic Elaeis guineensis (oil palm) single nucleotide polymorphism (SNP) in genomic region adjacent to shatterproof1 (SHELL) shell thickness gene
agatcttatcttctaattttgttcrgtctgtcttttgctttcgttgattt

SEQ ID NO: 4515 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttttttataggagtctcaatcaaraagaggtgtgaaacttttttggttt

SEQ ID NO: 4516 - DNA, 50 bp, Artificial Sequence
  synthetic Elaeis guineensis (oil palm) single nucleotide polymorphism (SNP) in genomic region adjacent to shatterproof1 (SHELL) shell thickness gene
caagacataggaagtcataataaaycgataaaatatcatataaaaataca

SEQ ID NO: 4517 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatattagctcggctatatcgcacrgttggaatgattgtcaccacatgca

SEQ ID NO: 4518 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttcccaataatagactccaaccccrttctatatataagagcgattcgagg

SEQ ID NO: 4519 - DNA, 50 bp, Artificial Sequence
  synthetic Elaeis guineensis (oil palm) single nucleotide polymorphism (SNP) in genomic region adjacent to shatterproof1 (SHELL) shell thickness gene
atagtttggattttagcaacaacayatctcaacaaatggcaaggatggtc

SEQ ID NO: 4520 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgacactctatctatccatctgctyatccgtaaatccaagccatagtcaa

SEQ ID NO: 4521 - DNA, 50 bp, Artificial Sequence
  synthetic Elaeis guineensis (oil palm) single nucleotide polymorphism (SNP) in genomic region adjacent to shatterproof1 (SHELL) shell thickness gene
atcatcgatttctttcttctcttgwccttccaacaaattttatatgtaga

SEQ ID NO: 4522 - DNA, 50 bp, Artificial Sequence
  synthetic Elaeis guineensis (oil palm) single nucleotide polymorphism (SNP) in genomic region adjacent to shatterproof1 (SHELL) shell thickness gene
tccatcttctatatcagttcgagtracaatattaaattttaaaaatatga

SEQ ID NO: 4523 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttgctgcgtactctgattttaattyatcaaattatataagtctattaaag

SEQ ID NO: 4524 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaaactcaagccaacatccttaartagaatcaacttgattatttcttat

SEQ ID NO: 4525 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttgacttgaataattaatacacttyaccatcttcaacaatcacaagaaaa

SEQ ID NO: 4526 - DNA, 50 bp, Artificial Sequence
  synthetic Elaeis guineensis (oil palm) single nucleotide polymorphism (SNP) in genomic region adjacent to shatterproof1 (SHELL) shell thickness gene
atcaaggaatcatattcagaatatratattttgagtaaccaaagatttca

SEQ ID NO: 4527 - DNA, 50 bp, Artificial Sequence
  synthetic Elaeis guineensis (oil palm) single nucleotide polymorphism (SNP) in genomic region adjacent to shatterproof1 (SHELL) shell thickness gene
agaccaaaacaataatgtaattttraaatattacatggctattttagaaa

SEQ ID NO: 4528 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttccattttcactggatgaaaacrgtggaggattatgttaggctgacag

SEQ ID NO: 4529 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccttcatctgcaagaaaaaagtaayctatgataattaacgtgttaatgca

SEQ ID NO: 4530 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaagtaacctatgataattaacgtrttaatgcataatggttatggtagca

SEQ ID NO: 4531 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaatactaagaaatcccattattktttaacaaaaaaacagctgcgctta

SEQ ID NO: 4532 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttcgttccagaaaattatgttcctmgagaactttttcttcaatgctaaca

SEQ ID NO: 4533 - DNA, 50 bp, Artificial Sequence
  synthetic Elaeis guineensis (oil palm) single nucleotide polymorphism (SNP) in genomic region adjacent to shatterproof1 (SHELL) shell thickness gene
gacggcaactgtataacgctataamataagaaaatataacaaagataaac

SEQ ID NO: 4534 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatataacaaagataaacaaatgcyccacatccacagaaagagagagaga

SEQ ID NO: 4535 - DNA, 50 bp, Artificial Sequence
  synthetic Elaeis guineensis (oil palm) single nucleotide polymorphism (SNP) in genomic region adjacent to shatterproof1 (SHELL) shell thickness gene
gacgcggtctgagccactcgttacragagagaacaaatgagaaccttttg

SEQ ID NO: 4536 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccgacaatctattcagataattgayaatttaaaatagacttatcaaatta

SEQ ID NO: 4537 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttttcctgcggtggctatcatgtcwataacttctagatgctgttttctta

SEQ ID NO: 4538 - DNA, 50 bp, Artificial Sequence
  synthetic Elaeis guineensis (oil palm) single nucleotide polymorphism (SNP) in genomic region adjacent to shatterproof1 (SHELL) shell thickness gene
cttcctttcactaagagatgcagtyggctgttttcctgcggtggctatca

SEQ ID NO: 4539 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtgctctgtcagcttcacttgcagycttctctgcctccctttggcactgc

SEQ ID NO: 4540 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttcctcagatcgaagaagcctttcracaatagacagcccatgaatccaat

SEQ ID NO: 4541 - DNA, 50 bp, Artificial Sequence
  synthetic Elaeis guineensis (oil palm) single nucleotide polymorphism (SNP) in genomic region adjacent to shatterproof1 (SHELL) shell thickness gene
agaccaattatacgtgccttctgcrtaccaccaatcaccatctttttcct

SEQ ID NO: 4542 - DNA, 50 bp, Artificial Sequence
  synthetic Elaeis guineensis (oil palm) single nucleotide polymorphism (SNP) in genomic region adjacent to shatterproof1 (SHELL) shell thickness gene
atagtataacatagatgtgaagcayagaccaattatacgtgccttctgca

SEQ ID NO: 4543 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttccaatagcatagcatcagttgaygacatctttcgcaattaatgttatg

SEQ ID NO: 4544 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaacttatcaggttataaagaattraagattgaagtttcttttaatgctt

SEQ ID NO: 4545 - DNA, 50 bp, Artificial Sequence
  synthetic Elaeis guineensis (oil palm) single nucleotide polymorphism (SNP) in genomic region adjacent to shatterproof1 (SHELL) shell thickness gene
aactagatgtcattctcaccagtcrctttgagatgtgaagcattatctgc

SEQ ID NO: 4546 - DNA, 50 bp, Artificial Sequence
  synthetic Elaeis guineensis (oil palm) single nucleotide polymorphism (SNP) in genomic region adjacent to shatterproof1 (SHELL) shell thickness gene
atttagtcgaaagctgtatttcatyataacctaatgacaaaaatgaatca

SEQ ID NO: 4547 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccaattctataccagtatacagtayaggaggcgaaccaacactcggtacg

SEQ ID NO: 4548 - DNA, 50 bp, Artificial Sequence
  synthetic Elaeis guineensis (oil palm) single nucleotide polymorphism (SNP) in genomic region adjacent to shatterproof1 (SHELL) shell thickness gene
taccgtaccaattctataccagtayacagtacaggaggcgaaccaacact

SEQ ID NO: 4549 - DNA, 50 bp, Artificial Sequence
  synthetic Elaeis guineensis (oil palm) single nucleotide polymorphism (SNP) in genomic region adjacent to shatterproof1 (SHELL) shell thickness gene
acatgttacaccacaccataccgawccatgtggtatggaacctaccgtac

SEQ ID NO: 4550 - DNA, 50 bp, Artificial Sequence
  synthetic Elaeis guineensis (oil palm) single nucleotide polymorphism (SNP) in genomic region adjacent to shatterproof1 (SHELL) shell thickness gene
caatgtgcattggaggttcctttargattcctccagaaacaggaatatgg

SEQ ID NO: 4551 - DNA, 50 bp, Artificial Sequence
  synthetic Elaeis guineensis (oil palm) single nucleotide polymorphism (SNP) in genomic region adjacent to shatterproof1 (SHELL) shell thickness gene
actccacattttgttattcacactyactagcgaatatcagcaaatcaggt

SEQ ID NO: 4552 - DNA, 50 bp, Artificial Sequence
  synthetic Elaeis guineensis (oil palm) single nucleotide polymorphism (SNP) in genomic region adjacent to shatterproof1 (SHELL) shell thickness gene
taactccacattttgttattcacaytcactagcgaatatcagcaaatcag

SEQ ID NO: 4553 - DNA, 50 bp, Artificial Sequence
  synthetic Elaeis guineensis (oil palm) single nucleotide polymorphism (SNP) in genomic region adjacent to shatterproof1 (SHELL) shell thickness gene
gatgggcaattgcctgctcacccayagtacatgaaacttgtagatatgca

SEQ ID NO: 4554 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggttctcactaatcaagatttgttrtacggccaaccaattatagaaggta

SEQ ID NO: 4555 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcgagtgactatgagcgtaattggkaaaccttcgtccttatccacagcaa

SEQ ID NO: 4556 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcacatcattttatgttcttttcargaaaagtatatggttcaggcaaaag

SEQ ID NO: 4557 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatacatgggcatggagcaagatcmcatcattttatgttcttttcaggaa

SEQ ID NO: 4558 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatgcaattgttcttaggcaaaaaraaaaatacatgggcatggagcaaga

SEQ ID NO: 4559 - DNA, 50 bp, Artificial Sequence
  synthetic Elaeis guineensis (oil palm) single nucleotide polymorphism (SNP) in genomic region adjacent to shatterproof1 (SHELL) shell thickness gene
catactgacaaagaaacaacttgcmatataaatttagtgtgctttattga

SEQ ID NO: 4560 - DNA, 50 bp, Artificial Sequence
  synthetic Elaeis guineensis (oil palm) single nucleotide polymorphism (SNP) in genomic region adjacent to shatterproof1 (SHELL) shell thickness gene
tccccccaagaaacttatagaaatycgctatctagatgggatattttaat

SEQ ID NO: 4561 - DNA, 50 bp, Artificial Sequence
  synthetic Elaeis guineensis (oil palm) single nucleotide polymorphism (SNP) in genomic region adjacent to shatterproof1 (SHELL) shell thickness gene
tagtgcttgatatttattttaaaayttatattataatttaatgtttaaca

SEQ ID NO: 4562 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttgtttatattcaacctcaaaaacytagctgatgtatagatcatttatta

SEQ ID NO: 4563 - DNA, 50 bp, Artificial Sequence
  synthetic Elaeis guineensis (oil palm) single nucleotide polymorphism (SNP) in genomic region adjacent to shatterproof1 (SHELL) shell thickness gene
attttttatttagataataataatwattatttttatttctagctatgtca

SEQ ID NO: 4564 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatttattgtaataaccatcatcakcctcatatcatcaccaccgtcatca

SEQ ID NO: 4565 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgcgcgcgcgcgtgtgtgtgtgtgwgagagagagagagaagatcaaatat

SEQ ID NO: 4566 - DNA, 50 bp, Artificial Sequence
  synthetic Elaeis guineensis (oil palm) single nucleotide polymorphism (SNP) in genomic region adjacent to shatterproof1 (SHELL) shell thickness gene
agaaggggatagaagagggagtgaygggggtccatggaagccaaatgaat

SEQ ID NO: 4567 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaagaacaacagtgagtgaatttgygacagaaggggatagaagagggagt

SEQ ID NO: 4568 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccaattcagtttgtttaattttgarccagctcgagtttggtccatgtagc

SEQ ID NO: 4569 - DNA, 50 bp, Artificial Sequence
  synthetic Elaeis guineensis (oil palm) single nucleotide polymorphism (SNP) in genomic region adjacent to shatterproof1 (SHELL) shell thickness gene
atcatctgtgcatagaggaggtctygggcacttgagcaaggcaaaggacc

SEQ ID NO: 4570 - DNA, 50 bp, Artificial Sequence
  synthetic Elaeis guineensis (oil palm) single nucleotide polymorphism (SNP) in genomic region adjacent to shatterproof1 (SHELL) shell thickness gene
caagcaaactatcatctcatacttmggtattgaaactgagaacagcgata

SEQ ID NO: 4571 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgtcttcacgaattacttatggtcyagcatatgtctattatgttgagtcc

SEQ ID NO: 4572 - DNA, 50 bp, Artificial Sequence
  synthetic Elaeis guineensis (oil palm) single nucleotide polymorphism (SNP) in genomic region adjacent to shatterproof1 (SHELL) shell thickness gene
gatgacgatgataacagaacttcartgcacctaaaaatatggataaacat

SEQ ID NO: 4573 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagtaataatgtaatagatccctgwaatgcatcaggcaattaaaatcaag

SEQ ID NO: 4574 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaataatattatatgcctggcttwcatctatcacagataactaattaaa

SEQ ID NO: 4575 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccaactagcatccagaaaacgtaaygacatatgcagtttgcaaagtttac

SEQ ID NO: 4576 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaccacaaaattatacaagttaagkttgcatttagctcattgtcagaaaa

SEQ ID NO: 4577 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgtcaaaaagtgagcaccacagacmacaaaattatacaagttaagtttgc

SEQ ID NO: 4578 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcaaactttctggacagaaagcttmttgtttgttctgaaccctaggatct

SEQ ID NO: 4579 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccattaattatattagctcatcccwaaaaacatcaaatattctacctaac

SEQ ID NO: 4580 - DNA, 50 bp, Artificial Sequence
  synthetic Elaeis guineensis (oil palm) single nucleotide polymorphism (SNP) in genomic region adjacent to shatterproof1 (SHELL) shell thickness gene
cttggtatgcctcagcacaaaaagyggtacaagatggtacggggcctgta

SEQ ID NO: 4581 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctaaagtacacttctaatttggtgsctcaaactcataaaactctttcgca

SEQ ID NO: 4582 - DNA, 50 bp, Artificial Sequence
  synthetic Elaeis guineensis (oil palm) single nucleotide polymorphism (SNP) in genomic region adjacent to shatterproof1 (SHELL) shell thickness gene
atgaaggtataatagcattaaaagrgttttggcagagttgtaagtgtaag

SEQ ID NO: 4583 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttacaaaaaaaagggtccttcatcwatggaaaacaaattgtaacaacctg

SEQ ID NO: 4584 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcccagttggtcttggtttctaccragcatcacatggactgaaccagcca

SEQ ID NO: 4585 - DNA, 50 bp, Artificial Sequence
  synthetic Elaeis guineensis (oil palm) single nucleotide polymorphism (SNP) in genomic region adjacent to shatterproof1 (SHELL) shell thickness gene
atagaattttagtagaccatgttcrtattcctaaggtcttgccaagttaa

SEQ ID NO: 4586 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaagaatcagtatttctgttaaaaycatatacggaagtctgacaaggaag

SEQ ID NO: 4587 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatattcttctctaacaagaaaaaraatcagtatttctgttaaaaccata

SEQ ID NO: 4588 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgatggaactaagggaactggaagygaaatagcaactcatataaatagca

SEQ ID NO: 4589 - DNA, 50 bp, Artificial Sequence
  synthetic Elaeis guineensis (oil palm) single nucleotide polymorphism (SNP) in genomic region adjacent to shatterproof1 (SHELL) shell thickness gene
taaaaagcacatattttggaaaacytaaaagattaccagcagagagtaga

SEQ ID NO: 4590 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaacggaacgatgtttttaattatyttaaaaagcacatattttggaaaac

SEQ ID NO: 4591 - DNA, 50 bp, Artificial Sequence
  synthetic Elaeis guineensis (oil palm) single nucleotide polymorphism (SNP) in genomic region adjacent to shatterproof1 (SHELL) shell thickness gene
cttaaccatcaatctgacatagctrctagagaaaacagaagaaagaagtt

SEQ ID NO: 4592 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctgccaatgaaagaatatgaggtgracagcacaaaggatttacaggtgac

SEQ ID NO: 4593 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagaacagatctgacttatcagcastatatttctttattcttgcattatt

SEQ ID NO: 4594 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtggttaagaccttagagatcactrtggtttcgatttccatggtttcgat

SEQ ID NO: 4595 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctgtgattgtctgtagaaagaggcygaagagagtcgagaattttatattt

SEQ ID NO: 4596 - DNA, 50 bp, Artificial Sequence
  synthetic Elaeis guineensis (oil palm) single nucleotide polymorphism (SNP) in genomic region adjacent to shatterproof1 (SHELL) shell thickness gene
ataataagcacatcgtgcatcacargaatctgaaagggtattgttttgaa

SEQ ID NO: 4597 - DNA, 50 bp, Artificial Sequence
  synthetic Elaeis guineensis (oil palm) single nucleotide polymorphism (SNP) in genomic region adjacent to shatterproof1 (SHELL) shell thickness gene
atacgaaaagtcagtatatccaaakacaaacagaagaaaaagaataatga

SEQ ID NO: 4598 - DNA, 50 bp, Artificial Sequence
  synthetic Elaeis guineensis (oil palm) single nucleotide polymorphism (SNP) in genomic region adjacent to shatterproof1 (SHELL) shell thickness gene
atgcaatgatgccaagaatgatacraaaagtcagtatatccaaatacaaa

SEQ ID NO: 4599 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaattacatataacagacacaaartccaagttatatataagttcatggg

SEQ ID NO: 4600 - DNA, 50 bp, Artificial Sequence
  synthetic Elaeis guineensis (oil palm) single nucleotide polymorphism (SNP) in genomic region adjacent to shatterproof1 (SHELL) shell thickness gene
catatacgaataaaatgaacaaagyatataaaaatgtgaccatagaataa

SEQ ID NO: 4601 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaactaagtatggcatgtaccgcrgtacacctccatacatactcatggt

SEQ ID NO: 4602 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcaaaactaagtatggcatgtaccrcggtacacctccatacatactcatg

SEQ ID NO: 4603 - DNA, 50 bp, Artificial Sequence
  synthetic Elaeis guineensis (oil palm) single nucleotide polymorphism (SNP) in genomic region adjacent to shatterproof1 (SHELL) shell thickness gene
atcacatcatgactgtgttaggctygttcagtttaaataaccaagtggtg

SEQ ID NO: 4604 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctgcatttcctacaacgccttaccrttctaaggaattacatctcatgcta

SEQ ID NO: 4605 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatttaaactcatgacttggtctaracaatttagccaagtgtcagtaact

SEQ ID NO: 4606 - DNA, 50 bp, Artificial Sequence
  synthetic Elaeis guineensis (oil palm) single nucleotide polymorphism (SNP) in genomic region adjacent to shatterproof1 (SHELL) shell thickness gene
taattgaggcatctcatgtgtcccytgacaacaatcacatgcacccatta

SEQ ID NO: 4607 - DNA, 50 bp, Artificial Sequence
  synthetic Elaeis guineensis (oil palm) single nucleotide polymorphism (SNP) in genomic region adjacent to shatterproof1 (SHELL) shell thickness gene
gagcttcaagctgcacaaattgctwattgaggcatctcatgtgtcccctg

SEQ ID NO: 4608 - DNA, 50 bp, Artificial Sequence
  synthetic Elaeis guineensis (oil palm) single nucleotide polymorphism (SNP) in genomic region adjacent to shatterproof1 (SHELL) shell thickness gene
gttgaatccaaattgcatatctgtstccatgcctcaaagaccatgattag

SEQ ID NO: 4609 - DNA, 50 bp, Artificial Sequence
  synthetic Elaeis guineensis (oil palm) single nucleotide polymorphism (SNP) in genomic region adjacent to shatterproof1 (SHELL) shell thickness gene
atctacatatgttgaatccaaattrcatatctgtgtccatgcctcaaaga

SEQ ID NO: 4610 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggaaaaggtgggaactagtaatatyatatcacattttttataggaattgc

SEQ ID NO: 4611 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaagatacgaccaagtcttgcctawtcaccattgctccactgcacaaaga

SEQ ID NO: 4612 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctcgcaatcttctctgaagatacgrccaagtcttgcctattcaccattgc

SEQ ID NO: 4613 - DNA, 50 bp, Artificial Sequence
  synthetic Elaeis guineensis (oil palm) single nucleotide polymorphism (SNP) in genomic region adjacent to shatterproof1 (SHELL) shell thickness gene
cacatgctacacatgatagttatargccattgtaatgatacatcatctgc

SEQ ID NO: 4614 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgagaacatgagtaagttggtcaawaaaaaagttgaccaactatcccatg

SEQ ID NO: 4615 - DNA, 50 bp, Artificial Sequence
  synthetic Elaeis guineensis (oil palm) single nucleotide polymorphism (SNP) in genomic region adjacent to shatterproof1 (SHELL) shell thickness gene
atgaggaagtaacttatccatcctkaaaagtatgagaacatgagtaagtt

SEQ ID NO: 4616 - DNA, 50 bp, Artificial Sequence
  synthetic Elaeis guineensis (oil palm) single nucleotide polymorphism (SNP) in genomic region adjacent to shatterproof1 (SHELL) shell thickness gene
taaagatatattaagaatgaattayagaggttattttttcgattgatgga

SEQ ID NO: 4617 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttctatattatattatattattatmtaataatatttatataatatattat

SEQ ID NO: 4618 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtaaaagattttgtattgctaagcrtaacatggtataagcatcactaaaa

SEQ ID NO: 4619 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaacatactgtcaacaccagtcccrtaacccgataccattttgttttggt

SEQ ID NO: 4620 - DNA, 50 bp, Artificial Sequence
  synthetic Elaeis guineensis (oil palm) single nucleotide polymorphism (SNP) in genomic region adjacent to shatterproof1 (SHELL) shell thickness gene
acctgacctatcagtgcatactgaygatttttcattcctttttgatactt

SEQ ID NO: 4621 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaaataaaggaagttcacaaactgyttagtctggtctaacatcctttttc

SEQ ID NO: 4622 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcaaaatgcaaagggtgacctcttmtcctcaaatctaatatgcctatatg

SEQ ID NO: 4623 - DNA, 50 bp, Artificial Sequence
  synthetic Elaeis guineensis (oil palm) single nucleotide polymorphism (SNP) in genomic region adjacent to shatterproof1 (SHELL) shell thickness gene
aacatattagaaaatagtttgcatyacaaaaatcctcaggttcgttacat

SEQ ID NO: 4624 - DNA, 50 bp, Artificial Sequence
  synthetic Elaeis guineensis (oil palm) single nucleotide polymorphism (SNP) in genomic region adjacent to shatterproof1 (SHELL) shell thickness gene
cttataattagccaaaaaaaaaaawcttaagaatgataacatgccagtaa

SEQ ID NO: 4625 - DNA, 50 bp, Artificial Sequence
  synthetic Elaeis guineensis (oil palm) single nucleotide polymorphism (SNP) in genomic region adjacent to shatterproof1 (SHELL) shell thickness gene
tagaagatgcacagcctaattatcytgatgagatccattagataaattaa

SEQ ID NO: 4626 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtgggataaaggcataaagctggtygaaccatcagtttacaattgcaatt

SEQ ID NO: 4627 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctccgaggtagagaagagtgccaycaatgtgggataaaggcataaagct

SEQ ID NO: 4628 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcgtaacaagcgattagcataggaraatttagaattctccgttagcgtaa

SEQ ID NO: 4629 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttcgtaacaagcgattagcataggraaatttagaattctccgttagcgta

SEQ ID NO: 4630 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctttatctcctcaccttgttaatgyggagaaattggtgaaaggaattcct

SEQ ID NO: 4631 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttttaccgagctttgaattagctytatctcctcaccttgttaatgtgga

SEQ ID NO: 4632 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcgaaccagagagaaactagaaacmagtggattccggtgagagtccaccg

SEQ ID NO: 4633 - DNA, 50 bp, Artificial Sequence
  synthetic Elaeis guineensis (oil palm) single nucleotide polymorphism (SNP) in genomic region adjacent to shatterproof1 (SHELL) shell thickness gene
acatcaaagattagcatgagatgcmgctgattgttttcagccgtggttca

SEQ ID NO: 4634 - DNA, 50 bp, Artificial Sequence
  synthetic Elaeis guineensis (oil palm) single nucleotide polymorphism (SNP) in genomic region adjacent to shatterproof1 (SHELL) shell thickness gene
acaagtccagataatttatgccgcyccttcagccagtacagcataatcta

SEQ ID NO: 4635 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtgtgtgtgtgtgtgtatgtatgtrtgtgtgtgtgtttgtgcagaaagca

SEQ ID NO: 4636 - DNA, 50 bp, Artificial Sequence
  synthetic Elaeis guineensis (oil palm) single nucleotide polymorphism (SNP) in genomic region adjacent to shatterproof1 (SHELL) shell thickness gene
aggtttaattaaagtaattagaacmtcaacagttaaaagaaaaaggggaa

SEQ ID NO: 4637 - DNA, 50 bp, Artificial Sequence
  synthetic Elaeis guineensis (oil palm) single nucleotide polymorphism (SNP) in genomic region adjacent to shatterproof1 (SHELL) shell thickness gene
ataaagaacatgtagctctctctcraagcagatgggcagcatgttcgacc

SEQ ID NO: 4638 - DNA, 50 bp, Artificial Sequence
  synthetic Elaeis guineensis (oil palm) single nucleotide polymorphism (SNP) in genomic region adjacent to shatterproof1 (SHELL) shell thickness gene
taatcctattgacttcaagatcttyccaattaaaggattcaaatgctaaa

SEQ ID NO: 4639 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggagacatcatcttctagtggctamtatcctgtgcaattcggagcgtctt

SEQ ID NO: 4640 - DNA, 50 bp, Artificial Sequence
  synthetic Elaeis guineensis (oil palm) single nucleotide polymorphism (SNP) in genomic region adjacent to shatterproof1 (SHELL) shell thickness gene
tagcaggagtcagagcttgatgagycagaatcgtctccacgacctgccag

SEQ ID NO: 4641 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcagtagcaggagtcagagcttgaygagccagaatcgtctccacgacctg

SEQ ID NO: 4642 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccaactacgagtgattttattaatraagatgaagatccgatgatcggatg

SEQ ID NO: 4643 - DNA, 50 bp, Artificial Sequence
  synthetic Elaeis guineensis (oil palm) single nucleotide polymorphism (SNP) in genomic region adjacent to shatterproof1 (SHELL) shell thickness gene
caaatgtattgagaaggaagttcarctgaagtactcagatccaactacga

SEQ ID NO: 4644 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctaaaataggaatgccataatgatmttgtgtacgtgcattataatttgag

SEQ ID NO: 4645 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggattcgcatgaaatttgaaagacyttgccatcaagatcctcttccagac

SEQ ID NO: 4646 - DNA, 50 bp, Artificial Sequence
  synthetic Elaeis guineensis (oil palm) single nucleotide polymorphism (SNP) in genomic region adjacent to shatterproof1 (SHELL) shell thickness gene
gttcaatgatatttattaacttagytgtatcttcaacagctaagatttta

SEQ ID NO: 4647 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaggggagcaatgtggagagcttartgacgagacaatcagcagatcgtga

SEQ ID NO: 4648 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatattgagaccagagatgtcacamgatttgctattaattatatagcact

SEQ ID NO: 4649 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaatccttgatgccaaaattgatgwagaaaggtactagcaacaacaatca

SEQ ID NO: 4650 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcccccatgactgatactttacatyttttatgggctgcaaacacttttat

SEQ ID NO: 4651 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcatggaacgtgttgcgaggaaaawatatacttttcaggatgacaatgag

SEQ ID NO: 4652 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatatagttcagcatggtatgaaayagcatatcgagcatcggcgtggtac

SEQ ID NO: 4653 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttctttgatttttttaatcctttyttctaaccaaaactctgaatcttga

SEQ ID NO: 4654 - DNA, 50 bp, Artificial Sequence
  synthetic Elaeis guineensis (oil palm) single nucleotide polymorphism (SNP) in genomic region adjacent to shatterproof1 (SHELL) shell thickness gene
gctctttttaagcatgacatcaatrctcactatcatacagagtcatttcc

SEQ ID NO: 4655 - DNA, 50 bp, Artificial Sequence
  synthetic Elaeis guineensis (oil palm) single nucleotide polymorphism (SNP) in genomic region adjacent to shatterproof1 (SHELL) shell thickness gene
atgccaacaagatatattgccatgkaaaggaaaatatgaatgtaaggggc

SEQ ID NO: 4656 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaggtattcaaacatttaaggtaycgttataagaaaagttcatatcata

SEQ ID NO: 4657 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctatcatcagaaaactgattaatgmtatgcaccaaaaggctaccaaaaag

SEQ ID NO: 4658 - DNA, 50 bp, Artificial Sequence
  synthetic Elaeis guineensis (oil palm) single nucleotide polymorphism (SNP) in genomic region adjacent to shatterproof1 (SHELL) shell thickness gene
cagataaatgcttaaaaagcaaaawtactaattctggtactcacgaatca

SEQ ID NO: 4659 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggataagcattctgaatcagagctwccagaagcgggtccaggtatggcga

SEQ ID NO: 4660 - DNA, 50 bp, Artificial Sequence
  synthetic Elaeis guineensis (oil palm) single nucleotide polymorphism (SNP) in genomic region adjacent to shatterproof1 (SHELL) shell thickness gene
atgtagaaatattaaaaagctggcrttggcaaatacacagtgtgctacat

SEQ ID NO: 4661 - DNA, 50 bp, Artificial Sequence
  synthetic Elaeis guineensis (oil palm) single nucleotide polymorphism (SNP) in genomic region adjacent to shatterproof1 (SHELL) shell thickness gene
caacatgtgatttgaagcttggtaygttgtaacggtttgttcatttgcat

SEQ ID NO: 4662 - DNA, 50 bp, Artificial Sequence
  synthetic Elaeis guineensis (oil palm) single nucleotide polymorphism (SNP) in genomic region adjacent to shatterproof1 (SHELL) shell thickness gene
cattctccatacaatagcatcaacyttttataagcttataattcaatcag

SEQ ID NO: 4663 - DNA, 50 bp, Artificial Sequence
  synthetic Elaeis guineensis (oil palm) single nucleotide polymorphism (SNP) in genomic region adjacent to shatterproof1 (SHELL) shell thickness gene
ataatgcatgaaggcagcatgtgawtaaactatcaccacaatcatagcat

SEQ ID NO: 4664 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatgctctggtactatataaaaagkgtctgaatttactaagatgaagtga

SEQ ID NO: 4665 - DNA, 50 bp, Artificial Sequence
  synthetic Elaeis guineensis (oil palm) single nucleotide polymorphism (SNP) in genomic region adjacent to shatterproof1 (SHELL) shell thickness gene
cgatccttgatgcgtcaagaatagkccgctcaatagagcatggattcata

SEQ ID NO: 4666 - DNA, 50 bp, Artificial Sequence
  synthetic Elaeis guineensis (oil palm) single nucleotide polymorphism (SNP) in genomic region adjacent to shatterproof1 (SHELL) shell thickness gene
ataccaaggcacgatccttgatgcrtcaagaatagtccgctcaatagagc

SEQ ID NO: 4667 - DNA, 50 bp, Artificial Sequence
  synthetic Elaeis guineensis (oil palm) single nucleotide polymorphism (SNP) in genomic region adjacent to shatterproof1 (SHELL) shell thickness gene
cgggagttccaacgagcatatgccygtcactggtatgtggtcctatgatc

SEQ ID NO: 4668 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctccaaagctatacccgggagttcyaacgagcatatgcctgtcactggta

SEQ ID NO: 4669 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaggtaacaaagatctttgagcacyagtagaagagtattttacagcttag

SEQ ID NO: 4670 - DNA, 50 bp, Artificial Sequence
  synthetic Elaeis guineensis (oil palm) single nucleotide polymorphism (SNP) in genomic region adjacent to shatterproof1 (SHELL) shell thickness gene
accatgatatcaaaggcaacgatgkggagagaaggtaacaaagatctttg

SEQ ID NO: 4671 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttagtttacatgtttggaagaggwagtcaaaagtcaagaccatgatatc

SEQ ID NO: 4672 - DNA, 50 bp, Artificial Sequence
  synthetic Elaeis guineensis (oil palm) single nucleotide polymorphism (SNP) in genomic region adjacent to shatterproof1 (SHELL) shell thickness gene
taaaaatttttgaaaattgttacakattactccctttttcttcgttcaat

SEQ ID NO: 4673 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttccggactttgggcagagacttyccatattattttgacttcccaaatc

SEQ ID NO: 4674 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtatgcaatcaaaatggttagctgrttggtttccggactttgggcagaga

SEQ ID NO: 4675 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaggttttgtttttgggctgcagcwacttttccaatttattgatggcgtt

SEQ ID NO: 4676 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgaaaggttttgtttttgggctgcrgctacttttccaatttattgatggc

SEQ ID NO: 4677 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcttgtgcctaatatttttacttcratatacactaacttctataacccaa

SEQ ID NO: 4678 - DNA, 50 bp, Artificial Sequence
  synthetic Elaeis guineensis (oil palm) single nucleotide polymorphism (SNP) in genomic region adjacent to shatterproof1 (SHELL) shell thickness gene
attccttttttcttgctgttttgcrtgggcatggagtaaactgtgtgaat

SEQ ID NO: 4679 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcttattcttctgttagttttgatkgacagcagaccttacctgtttgaaa

SEQ ID NO: 4680 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaacatgtttgtcccactcagattktttatataatagagaccacttttct

SEQ ID NO: 4681 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcaaatttaattttattatgcactkatctgaccaaatcaatggttaatta

SEQ ID NO: 4682 - DNA, 50 bp, Artificial Sequence
  synthetic Elaeis guineensis (oil palm) single nucleotide polymorphism (SNP) in genomic region adjacent to shatterproof1 (SHELL) shell thickness gene
agtaattaattgagaataggaagaygagcgttaaaatcttgaaggcgagc

SEQ ID NO: 4683 - DNA, 50 bp, Artificial Sequence
  synthetic Elaeis guineensis (oil palm) single nucleotide polymorphism (SNP) in genomic region adjacent to shatterproof1 (SHELL) shell thickness gene
actttctttaacttctcaattttcyatatgtttagaatttatattttgtt

SEQ ID NO: 4684 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcaccttgttatgtgagtaatcacmtttccttccctcctttcttgctttt

SEQ ID NO: 4685 - DNA, 50 bp, Artificial Sequence
  synthetic Elaeis guineensis (oil palm) single nucleotide polymorphism (SNP) in genomic region adjacent to shatterproof1 (SHELL) shell thickness gene
taactctgcctcctagtcggcaccytgttatgtgagtaatcacatttcct

SEQ ID NO: 4686 - DNA, 50 bp, Artificial Sequence
  synthetic Elaeis guineensis (oil palm) single nucleotide polymorphism (SNP) in genomic region adjacent to shatterproof1 (SHELL) shell thickness gene
agcccttaactctgcctcctagtcrgcaccttgttatgtgagtaatcaca

SEQ ID NO: 4687 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcatacaaactaatgacctcaaggytaagtcctctaaacccaacagcttg

SEQ ID NO: 4688 - DNA, 50 bp, Artificial Sequence
  synthetic Elaeis guineensis (oil palm) single nucleotide polymorphism (SNP) in genomic region adjacent to shatterproof1 (SHELL) shell thickness gene
cattcgacccggtaaattatagacrtatgatagatagtgaaatgtctcaa

SEQ ID NO: 4689 - DNA, 50 bp, Artificial Sequence
  synthetic Elaeis guineensis (oil palm) single nucleotide polymorphism (SNP) in genomic region adjacent to shatterproof1 (SHELL) shell thickness gene
tggtcatccttatagaatgatgtcyagcatccttcgaaaataatttgcat

SEQ ID NO: 4690 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctatctatttgagtcaaacatccarctttgtgtacagattaagacctgaa

SEQ ID NO: 4691 - DNA, 50 bp, Artificial Sequence
  synthetic Elaeis guineensis (oil palm) single nucleotide polymorphism (SNP) in genomic region adjacent to shatterproof1 (SHELL) shell thickness gene
gatcttgacacaacactcaaattcwtatagatcatacgcaacctctttca

SEQ ID NO: 4692 - DNA, 50 bp, Artificial Sequence
  synthetic Elaeis guineensis (oil palm) single nucleotide polymorphism (SNP) in genomic region adjacent to shatterproof1 (SHELL) shell thickness gene
acctgaccctatattaattggcacraggcttgatgaatatgattatggct

SEQ ID NO: 4693 - DNA, 50 bp, Artificial Sequence
  synthetic Elaeis guineensis (oil palm) single nucleotide polymorphism (SNP) in genomic region adjacent to shatterproof1 (SHELL) shell thickness gene
ataagcttgacttaacatcaggggmagcagccctcaatattaatcttgtg

SEQ ID NO: 4694 - DNA, 50 bp, Artificial Sequence
  synthetic Elaeis guineensis (oil palm) single nucleotide polymorphism (SNP) in genomic region adjacent to shatterproof1 (SHELL) shell thickness gene
aggcaagtttttgctcaagaatgtrggaagaggaggtgaaggcctttggt

SEQ ID NO: 4695 - DNA, 50 bp, Artificial Sequence
  synthetic Elaeis guineensis (oil palm) single nucleotide polymorphism (SNP) in genomic region adjacent to shatterproof1 (SHELL) shell thickness gene
attctagaggaatcacaggagctgyataaattaaggctaaagtgatggaa

SEQ ID NO: 4696 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatgagctattctagaggaatcacrggagctgcataaattaaggctaaag

SEQ ID NO: 4697 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttatagaatggccacagggcttcyaatgttgtatggtttagaaagatgg

SEQ ID NO: 4698 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcatgtgattgatgtatgccttggytacttagctgaagattttatagaat

SEQ ID NO: 4699 - DNA, 50 bp, Artificial Sequence
  synthetic Elaeis guineensis (oil palm) single nucleotide polymorphism (SNP) in genomic region adjacent to shatterproof1 (SHELL) shell thickness gene
taggtatagttgaattatgagaatyttgtgaaatttgtttttatgtgcaa

SEQ ID NO: 4700 - DNA, 50 bp, Artificial Sequence
  synthetic Elaeis guineensis (oil palm) single nucleotide polymorphism (SNP) in genomic region adjacent to shatterproof1 (SHELL) shell thickness gene
cagctaaatggtgctaactattatygagccttctgaagaatatcagtagt

SEQ ID NO: 4701 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttttattgtacaaagcaacttatgyaggttctttatgatcagaccattct

SEQ ID NO: 4702 - DNA, 50 bp, Artificial Sequence
  synthetic Elaeis guineensis (oil palm) single nucleotide polymorphism (SNP) in genomic region adjacent to shatterproof1 (SHELL) shell thickness gene
agcatctatgaaagcaaggcaaagygtaagaaaatggagactgaaggaga

SEQ ID NO: 4703 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttttgagaaaaagaaagcacatgrctcctcattctaatcaaaatttcgg

SEQ ID NO: 4704 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaaccatcacctgaaatccagaaktgcatatctatataaatgagcttct

SEQ ID NO: 4705 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggagactcattagcattttaagttmgatgggagaaatgaaacggaaaaag

SEQ ID NO: 4706 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaaacaaaatgatgcaaatcctcyagaaatcaccaactctacctacaat

SEQ ID NO: 4707 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaataaaatagctcccaacatcccwacttaaagaaaaacagaaaaatttt

SEQ ID NO: 4708 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtgcgggatttggtgccggtatttwaaacctcagtaggaatttcataaaa

SEQ ID NO: 4709 - DNA, 50 bp, Artificial Sequence
  synthetic Elaeis guineensis (oil palm) single nucleotide polymorphism (SNP) in genomic region adjacent to shatterproof1 (SHELL) shell thickness gene
gatggaaagatagtgcgggatttgrtgccggtattttaaacctcagtagg

SEQ ID NO: 4710 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgatggaaagatagtgcgggatttrgtgccggtattttaaacctcagtag

SEQ ID NO: 4711 - DNA, 50 bp, Artificial Sequence
  synthetic Elaeis guineensis (oil palm) single nucleotide polymorphism (SNP) in genomic region adjacent to shatterproof1 (SHELL) shell thickness gene
agcatgtaccatcgatacttgtacygcagtgatacgtaccattttgatgg

SEQ ID NO: 4712 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctttgcacatgatataccatctcarccaattctccatccctttaacctca

SEQ ID NO: 4713 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttttcaataattgctatcaagatwtacctttggtatttcttcaaaattt

SEQ ID NO: 4714 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccaattattgcaaatataatcatawgtattctatcaaaattataaccata

SEQ ID NO: 4715 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagcaaggttcattcttcatcctaraaaaaagcaggagggaacaaagtac

SEQ ID NO: 4716 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaacagcaaggcagaggggtagacmtgattgggcatatattataactagg

SEQ ID NO: 4717 - DNA, 50 bp, Artificial Sequence
  synthetic Elaeis guineensis (oil palm) single nucleotide polymorphism (SNP) in genomic region adjacent to shatterproof1 (SHELL) shell thickness gene
tagccacttctaaggaaattcacayccaaaaataagccaaatcaaacaac

SEQ ID NO: 4718 - DNA, 50 bp, Artificial Sequence
  synthetic Elaeis guineensis (oil palm) single nucleotide polymorphism (SNP) in genomic region adjacent to shatterproof1 (SHELL) shell thickness gene
taagcagaccaaatggattcttcastcatctaaaaaggaccaggaaaata

SEQ ID NO: 4719 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcctgggctaacaagctagaaactraatgaaaaagaatctatatatttgg

SEQ ID NO: 4720 - DNA, 50 bp, Artificial Sequence
  synthetic Elaeis guineensis (oil palm) single nucleotide polymorphism (SNP) in genomic region adjacent to shatterproof1 (SHELL) shell thickness gene
atatatatatatttcttgataagawgaagggcagaccctctacaatctgg

SEQ ID NO: 4721 - DNA, 50 bp, Artificial Sequence
  synthetic Elaeis guineensis (oil palm) single nucleotide polymorphism (SNP) in genomic region adjacent to shatterproof1 (SHELL) shell thickness gene
tattttcaattacagcaaaaggaasagagacaggagagcaacaattataa

SEQ ID NO: 4722 - DNA, 50 bp, Artificial Sequence
  synthetic Elaeis guineensis (oil palm) single nucleotide polymorphism (SNP) in genomic region adjacent to shatterproof1 (SHELL) shell thickness gene
gccatggcacatccattttctgtcrtccatgaatttctttgttatagaat

SEQ ID NO: 4723 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtgacaggctcacatgaatcttatyatcatcacgtgactcgacaactatc

SEQ ID NO: 4724 - DNA, 50 bp, Artificial Sequence
  synthetic Elaeis guineensis (oil palm) single nucleotide polymorphism (SNP) in genomic region adjacent to shatterproof1 (SHELL) shell thickness gene
gctggaaacatattgtctggaaatraatagggcaactttggaaaatgcaa

SEQ ID NO: 4725 - DNA, 50 bp, Artificial Sequence
  synthetic Elaeis guineensis (oil palm) single nucleotide polymorphism (SNP) in genomic region adjacent to shatterproof1 (SHELL) shell thickness gene
atagcaaattggaagttgccacagmatatctaccaaaaattaccttttac

SEQ ID NO: 4726 - DNA, 50 bp, Artificial Sequence
  synthetic Elaeis guineensis (oil palm) single nucleotide polymorphism (SNP) in genomic region adjacent to shatterproof1 (SHELL) shell thickness gene
gttctcgaaattacagaccatattycatattttgaaagagttaaaataaa

SEQ ID NO: 4727 - DNA, 50 bp, Artificial Sequence
  synthetic Elaeis guineensis (oil palm) single nucleotide polymorphism (SNP) in genomic region adjacent to shatterproof1 (SHELL) shell thickness gene
catctcactcataaaattggcactraagtatttgcgaaatggggtgatga

SEQ ID NO: 4728 - DNA, 50 bp, Artificial Sequence
  synthetic Elaeis guineensis (oil palm) single nucleotide polymorphism (SNP) in genomic region adjacent to shatterproof1 (SHELL) shell thickness gene
atttggtggcctaaaagccaacttragtttctatgagatggacatctcac

SEQ ID NO: 4729 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttttagaaacttcatacgtaattawaagattgtatataatatgcaaacaa

SEQ ID NO: 4730 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctcttttgtccaggcatctttctcraccattacttcaggaacagaaaagt

SEQ ID NO: 4731 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaccagaagaaccagaaggataccyccaatcctctttactttcattcaac

SEQ ID NO: 4732 - DNA, 50 bp, Artificial Sequence
  synthetic Elaeis guineensis (oil palm) single nucleotide polymorphism (SNP) in genomic region adjacent to shatterproof1 (SHELL) shell thickness gene
catcgcaaaataatggacaggaagrggtttggttggtataggctaggccg

SEQ ID NO: 4733 - DNA, 50 bp, Artificial Sequence
  synthetic Elaeis guineensis (oil palm) single nucleotide polymorphism (SNP) in genomic region adjacent to shatterproof1 (SHELL) shell thickness gene
atagaattcataaggacattggccrggtaggatttatgttcgtagcattc

SEQ ID NO: 4734 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttctaagattgaaaatagtcaaaayaacttgatggtctatttgaataatt

SEQ ID NO: 4735 - DNA, 50 bp, Artificial Sequence
  synthetic Elaeis guineensis (oil palm) single nucleotide polymorphism (SNP) in genomic region adjacent to shatterproof1 (SHELL) shell thickness gene
atgaaggaagatgaatcattctttrgtgcgaaagatacacgtctgatatg

SEQ ID NO: 4736 - DNA, 50 bp, Artificial Sequence
  synthetic Elaeis guineensis (oil palm) single nucleotide polymorphism (SNP) in genomic region adjacent to shatterproof1 (SHELL) shell thickness gene
attaccctgcatgtgagattgggayaagccatggatggataagaaagtct

SEQ ID NO: 4737 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttcacatgcattaccctgcatgtsagattgggataagccatggatggat

SEQ ID NO: 4738 - DNA, 50 bp, Artificial Sequence
  synthetic Elaeis guineensis (oil palm) single nucleotide polymorphism (SNP) in genomic region adjacent to shatterproof1 (SHELL) shell thickness gene
aactaggctttcaaagctccatatwgaagggcaacttggtcccaatgaac

SEQ ID NO: 4739 - DNA, 50 bp, Artificial Sequence
  synthetic Elaeis guineensis (oil palm) single nucleotide polymorphism (SNP) in genomic region adjacent to shatterproof1 (SHELL) shell thickness gene
acccatttttctaatccgacacgcygaggatgggtagtactggcaacatc

SEQ ID NO: 4740 - DNA, 50 bp, Artificial Sequence
  synthetic Elaeis guineensis (oil palm) single nucleotide polymorphism (SNP) in genomic region adjacent to shatterproof1 (SHELL) shell thickness gene
ataaaagagaagaggaccagcctgrgcgcgaaactactaaaatgcccccc

SEQ ID NO: 4741 - DNA, 50 bp, Artificial Sequence
  synthetic Elaeis guineensis (oil palm) single nucleotide polymorphism (SNP) in genomic region adjacent to shatterproof1 (SHELL) shell thickness gene
cctcgccccgaccaacatcgaccgytggagcaccgtacccaccaccgcca

SEQ ID NO: 4742 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaagcagataaaaattaagaccaaygtgcgtcttgtagtgcagacattcc

SEQ ID NO: 4743 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttttttgcaaatattcacaaaaacmgtccattcgaagcagataaaaatta

SEQ ID NO: 4744 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaatccaaagaaaacagaaatttcmcgttgctacaccagataaaaaataa

SEQ ID NO: 4745 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatgcaaaaaattatgcaaatctcrgtaagcattttaaacacacttcaaa

SEQ ID NO: 4746 - DNA, 50 bp, Artificial Sequence
  synthetic Elaeis guineensis (oil palm) single nucleotide polymorphism (SNP) in genomic region adjacent to shatterproof1 (SHELL) shell thickness gene
taatgaaactggaggaggatgaatkgccaaaaaagaaaaagcagctatat

SEQ ID NO: 4747 - DNA, 50 bp, Artificial Sequence
  synthetic Elaeis guineensis (oil palm) single nucleotide polymorphism (SNP) in genomic region adjacent to shatterproof1 (SHELL) shell thickness gene
agatgatcacaccgaatgtcacttyggaacaaactctaatatacagctca

SEQ ID NO: 4748 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagcatgtttttagtcattggctcmtaaaaactttcactagttttccccg

SEQ ID NO: 4749 - DNA, 50 bp, Artificial Sequence
  synthetic Elaeis guineensis (oil palm) single nucleotide polymorphism (SNP) in genomic region adjacent to shatterproof1 (SHELL) shell thickness gene
caaaaaagttcctataaactttaaygcagcatggctacatcaacagccaa

SEQ ID NO: 4750 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaacttaagaaatcaaaaaattaktatagcagaatcagttcaataagaa

SEQ ID NO: 4751 - DNA, 50 bp, Artificial Sequence
  synthetic Elaeis guineensis (oil palm) single nucleotide polymorphism (SNP) in genomic region adjacent to shatterproof1 (SHELL) shell thickness gene
acctttctagtgaaatgatgaatgmagatcaggggaaacaagaaaacaca

SEQ ID NO: 4752 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatgttacagttgtaatagttgaasgatacgtaagacacctttctagtga

SEQ ID NO: 4753 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaaaaaaaaaaagaaaagcatgaaygttacagttgtaatagttgaacgat

SEQ ID NO: 4754 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagaattaagtgggcttagccaacraaggctgcaaaaacaaactagcata

SEQ ID NO: 4755 - DNA, 50 bp, Artificial Sequence
  synthetic Elaeis guineensis (oil palm) single nucleotide polymorphism (SNP) in genomic region adjacent to shatterproof1 (SHELL) shell thickness gene
aggaaaaaatggaaagaattaagtrggcttagccaacaaaggctgcaaaa

SEQ ID NO: 4756 - DNA, 50 bp, Artificial Sequence
  synthetic Elaeis guineensis (oil palm) single nucleotide polymorphism (SNP) in genomic region adjacent to shatterproof1 (SHELL) shell thickness gene
agaaaggaaaaaatggaaagaattmagtgggcttagccaacaaaggctgc

SEQ ID NO: 4757 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccagaaaaccatttgaacttttaaytttaaaatcactgaaaataaaaata

SEQ ID NO: 4758 - DNA, 50 bp, Artificial Sequence
  synthetic Elaeis guineensis (oil palm) single nucleotide polymorphism (SNP) in genomic region adjacent to shatterproof1 (SHELL) shell thickness gene
atgggaggatgccatatggatcttraaacagtaaatcccagaaaaccatt

SEQ ID NO: 4759 - DNA, 50 bp, Artificial Sequence
  synthetic Elaeis guineensis (oil palm) single nucleotide polymorphism (SNP) in genomic region adjacent to shatterproof1 (SHELL) shell thickness gene
catataaaataatcgataaagtaaygggaggatgccatatggatcttaaa

SEQ ID NO: 4760 - DNA, 50 bp, Artificial Sequence
  synthetic Elaeis guineensis (oil palm) single nucleotide polymorphism (SNP) in genomic region adjacent to shatterproof1 (SHELL) shell thickness gene
attgtgaacacatgatacctacatrtactttttagaaagtaacagatatt

SEQ ID NO: 4761 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgctatatggcaaattaattcaacwaaaaccatagttttcaagaataaaa

SEQ ID NO: 4762 - DNA, 50 bp, Artificial Sequence
  synthetic Elaeis guineensis (oil palm) single nucleotide polymorphism (SNP) in genomic region adjacent to shatterproof1 (SHELL) shell thickness gene
atgcatgcacgcacgagagagagaragagagagagatcaaaatgcatagg

SEQ ID NO: 4763 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggacattgacattgtcaaacatgcrcatgtatgcatgcacgcacgagaga

SEQ ID NO: 4764 - DNA, 50 bp, Artificial Sequence
  synthetic Elaeis guineensis (oil palm) single nucleotide polymorphism (SNP) in genomic region adjacent to shatterproof1 (SHELL) shell thickness gene
tccccttttatgtgaaaaataagcrtatgcctggtaagatgccctttttg

SEQ ID NO: 4765 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatgcaaaaccgaagcgtgggaggyttataatttttaatcgagttatgga

SEQ ID NO: 4766 - DNA, 50 bp, Artificial Sequence
  synthetic Elaeis guineensis (oil palm) single nucleotide polymorphism (SNP) in genomic region adjacent to shatterproof1 (SHELL) shell thickness gene
agcaaaaactaagcattaacaatakaatctaaattttacatttaggtcca

SEQ ID NO: 4767 - DNA, 50 bp, Artificial Sequence
  synthetic Elaeis guineensis (oil palm) single nucleotide polymorphism (SNP) in genomic region adjacent to shatterproof1 (SHELL) shell thickness gene
caagcaaaaactaagcattaacaakagaatctaaattttacatttaggtc

SEQ ID NO: 4768 - DNA, 50 bp, Artificial Sequence
  synthetic Elaeis guineensis (oil palm) single nucleotide polymorphism (SNP) in genomic region adjacent to shatterproof1 (SHELL) shell thickness gene
atgaaaacattaaggatactaaaayaaaaaatatatcctgaaacctgata

SEQ ID NO: 4769 - DNA, 50 bp, Artificial Sequence
  synthetic Elaeis guineensis (oil palm) single nucleotide polymorphism (SNP) in genomic region adjacent to shatterproof1 (SHELL) shell thickness gene
aggatcatatattaaacaaaatcawgacaaacaatttatatagaagggta

SEQ ID NO: 4770 - DNA, 50 bp, Artificial Sequence
  synthetic Elaeis guineensis (oil palm) single nucleotide polymorphism (SNP) in genomic region adjacent to shatterproof1 (SHELL) shell thickness gene
attataatccaattagtaagtgggrgtcctattattggaattctcgttga

SEQ ID NO: 4771 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgggaggtgtttttgtgttaagctyggtcattttcagtgtcgggatttta

SEQ ID NO: 4772 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttgtggaattgaatgggaggtgttyttgtgttaagctcggtcattttcag

SEQ ID NO: 4773 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtttcatgcattttttttataattygattgtggaattgaatgggaggtgt

SEQ ID NO: 4774 - DNA, 50 bp, Artificial Sequence
  synthetic Elaeis guineensis (oil palm) single nucleotide polymorphism (SNP) in genomic region adjacent to shatterproof1 (SHELL) shell thickness gene
caacatgtacatacccatatcaagrcattaaaacaagccaatcaattaat

SEQ ID NO: 4775 - DNA, 50 bp, Artificial Sequence
  synthetic Elaeis guineensis (oil palm) single nucleotide polymorphism (SNP) in genomic region adjacent to shatterproof1 (SHELL) shell thickness gene
catccagttatatattatcatctayggttcaaaatatgcatcataaaaca

SEQ ID NO: 4776 - DNA, 50 bp, Artificial Sequence
  synthetic Elaeis guineensis (oil palm) single nucleotide polymorphism (SNP) in genomic region adjacent to shatterproof1 (SHELL) shell thickness gene
atattacgttgggagataagaaaamctgtgtacctctaagatagataaca

SEQ ID NO: 4777 - DNA, 50 bp, Artificial Sequence
  synthetic Elaeis guineensis (oil palm) single nucleotide polymorphism (SNP) in genomic region adjacent to shatterproof1 (SHELL) shell thickness gene
aactttatgatctatctcatcgtaytttaaaattagttaaaagtgcaacc

SEQ ID NO: 4778 - DNA, 50 bp, Artificial Sequence
  synthetic Elaeis guineensis (oil palm) single nucleotide polymorphism (SNP) in genomic region adjacent to shatterproof1 (SHELL) shell thickness gene
cgtattttacataatatttaaaagrtaatattaactttatgatctatctc

SEQ ID NO: 4779 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcttttacaatatcaacaattgggkcgtattttacataatatttaaaagg

SEQ ID NO: 4780 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcgttgctgtcggagtggctctcartgctgaaacgctcgcggtgggacga

SEQ ID NO: 4781 - DNA, 50 bp, Artificial Sequence
  synthetic Elaeis guineensis (oil palm) single nucleotide polymorphism (SNP) in genomic region adjacent to shatterproof1 (SHELL) shell thickness gene
accatcatcatccgctcgcagtcckccagctccattggcgagggatccac

SEQ ID NO: 4782 - DNA, 50 bp, Artificial Sequence
  synthetic Elaeis guineensis (oil palm) single nucleotide polymorphism (SNP) in genomic region adjacent to shatterproof1 (SHELL) shell thickness gene
acgaagaaaagaagggcaagaaggraggagacgacctgtcaagagccgac

SEQ ID NO: 4783 - DNA, 50 bp, Artificial Sequence
  synthetic Elaeis guineensis (oil palm) single nucleotide polymorphism (SNP) in genomic region adjacent to shatterproof1 (SHELL) shell thickness gene
atcttgactcgaatcccaaatccasccaaaaacccacagaacggaatcaa

SEQ ID NO: 4784 - DNA, 50 bp, Artificial Sequence
  synthetic Elaeis guineensis (oil palm) single nucleotide polymorphism (SNP) in genomic region adjacent to shatterproof1 (SHELL) shell thickness gene
acagattgatacttattttgttacsaacatttctctaatcataacccaga

SEQ ID NO: 4785 - DNA, 50 bp, Artificial Sequence
  synthetic Elaeis guineensis (oil palm) single nucleotide polymorphism (SNP) in genomic region adjacent to shatterproof1 (SHELL) shell thickness gene
atataaccactaaagataagaaagyaaccgagaaagaaaactttctgtac

SEQ ID NO: 4786 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtatcggaatggaaaacgtccttgyagaaagtttgcaccaggcccacgcc

SEQ ID NO: 4787 - DNA, 50 bp, Artificial Sequence
  synthetic Elaeis guineensis (oil palm) single nucleotide polymorphism (SNP) in genomic region adjacent to shatterproof1 (SHELL) shell thickness gene
cacgtatagttgcagcaagtctcaragtaactataaatttgcagcaaaaa

SEQ ID NO: 4788 - DNA, 50 bp, Artificial Sequence
  synthetic Elaeis guineensis (oil palm) single nucleotide polymorphism (SNP) in genomic region adjacent to shatterproof1 (SHELL) shell thickness gene
gttaccaacgcattaattagaagaygatctaatttcattcccaagatgct

SEQ ID NO: 4789 - DNA, 50 bp, Artificial Sequence
  synthetic Elaeis guineensis (oil palm) single nucleotide polymorphism (SNP) in genomic region adjacent to shatterproof1 (SHELL) shell thickness gene
tccgactgagtagcatatattctcrtgaacaaagaggggaaagaagcaga

SEQ ID NO: 4790 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgaatccgactgagtagcatatatyctcgtgaacaaagaggggaaagaag

SEQ ID NO: 4791 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaattatacacacaaatgacagtcytttagatgtttgaatccgactgagt

SEQ ID NO: 4792 - DNA, 50 bp, Artificial Sequence
  synthetic Elaeis guineensis (oil palm) single nucleotide polymorphism (SNP) in genomic region adjacent to shatterproof1 (SHELL) shell thickness gene
ataagaaaattatacacacaaatgrcagtcttttagatgtttgaatccga

SEQ ID NO: 4793 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccgtactaataaatcatattagatkcaatgaaaaggaacataagtgccct

SEQ ID NO: 4794 - DNA, 50 bp, Artificial Sequence
  synthetic Elaeis guineensis (oil palm) single nucleotide polymorphism (SNP) in genomic region adjacent to shatterproof1 (SHELL) shell thickness gene
atccaccagaactactggtcttagkccagtgcataaacaaagtatgtctg

SEQ ID NO: 4795 - DNA, 50 bp, Artificial Sequence
  synthetic Elaeis guineensis (oil palm) single nucleotide polymorphism (SNP) in genomic region adjacent to shatterproof1 (SHELL) shell thickness gene
acctcctgggcaaggcgaagtagtragcagaggtcctcttggagttttgg

SEQ ID NO: 4796 - DNA, 50 bp, Artificial Sequence
  synthetic Elaeis guineensis (oil palm) single nucleotide polymorphism (SNP) in genomic region adjacent to shatterproof1 (SHELL) shell thickness gene
cactatctaatacaacttcactaaraagcctatgagatttccataagaca

SEQ ID NO: 4797 - DNA, 50 bp, Artificial Sequence
  synthetic Elaeis guineensis (oil palm) single nucleotide polymorphism (SNP) in genomic region adjacent to shatterproof1 (SHELL) shell thickness gene
aggaaaaaatctacatgtttctttytgtcttccataaatctacaggaggg

SEQ ID NO: 4798 - DNA, 50 bp, Artificial Sequence
  synthetic Elaeis guineensis (oil palm) single nucleotide polymorphism (SNP) in genomic region adjacent to shatterproof1 (SHELL) shell thickness gene
acatgatatctacgctttaaggaamaaatctacatgtttctttttgtctt

SEQ ID NO: 4799 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatagaagatatcctcttatttcawtgagattttttttcttttactttcc

SEQ ID NO: 4800 - DNA, 50 bp, Artificial Sequence
  synthetic Elaeis guineensis (oil palm) single nucleotide polymorphism (SNP) in genomic region adjacent to shatterproof1 (SHELL) shell thickness gene
taaaaaataacaaatttatagaagwtatcctcttatttcaatgagatttt

SEQ ID NO: 4801 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccaactcatactctctcaccctcascccccaatcttgttctctcttcatt

SEQ ID NO: 4802 - DNA, 50 bp, Artificial Sequence
  synthetic Elaeis guineensis (oil palm) single nucleotide polymorphism (SNP) in genomic region adjacent to shatterproof1 (SHELL) shell thickness gene
taatacctctatctcgtactctctsactctctctttcccttgctctgttt

SEQ ID NO: 4803 - DNA, 50 bp, Artificial Sequence
  synthetic Elaeis guineensis (oil palm) single nucleotide polymorphism (SNP) in genomic region adjacent to shatterproof1 (SHELL) shell thickness gene
cctattatacctcagaggtaaccarttaaaagttgctaagtactcaaatc

SEQ ID NO: 4804 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttttgatgcaaatatccagcctggkggaaacctattatacctcagaggta

SEQ ID NO: 4805 - DNA, 50 bp, Artificial Sequence
  synthetic Elaeis guineensis (oil palm) single nucleotide polymorphism (SNP) in genomic region adjacent to shatterproof1 (SHELL) shell thickness gene
cttaaatgtttaagtttctactgtwtccaaaaccaattttggagtgtagg

SEQ ID NO: 4806 - DNA, 50 bp, Artificial Sequence
  synthetic Elaeis guineensis (oil palm) single nucleotide polymorphism (SNP) in genomic region adjacent to shatterproof1 (SHELL) shell thickness gene
cttggtctatcttagctctgtatawtaaaagactaaatcagagcttatca

SEQ ID NO: 4807 - DNA, 50 bp, Artificial Sequence
  synthetic Elaeis guineensis (oil palm) single nucleotide polymorphism (SNP) in genomic region adjacent to shatterproof1 (SHELL) shell thickness gene
tggaccatcactaccctctccaatrgagcacttggtctatcttagctctg

SEQ ID NO: 4808 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaaaaccgggacacctctgtcccaygagatttaagaccttagtctttagc

SEQ ID NO: 4809 - DNA, 50 bp, Artificial Sequence
  synthetic Elaeis guineensis (oil palm) single nucleotide polymorphism (SNP) in genomic region adjacent to shatterproof1 (SHELL) shell thickness gene
attagatcgcatgatcaggactgcwatcgagacaagactagacagtgggg

SEQ ID NO: 4810 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaagaaagaaaaaaagaattaggrgagagagatggaggatatctattag

SEQ ID NO: 4811 - DNA, 50 bp, Artificial Sequence
  synthetic Elaeis guineensis (oil palm) single nucleotide polymorphism (SNP) in genomic region adjacent to shatterproof1 (SHELL) shell thickness gene
agaaaagaaaaaaaagagaaagggrtaaggaaagaaagaaaaaataaagg

SEQ ID NO: 4812 - DNA, 50 bp, Artificial Sequence
  synthetic Elaeis guineensis (oil palm) single nucleotide polymorphism (SNP) in genomic region adjacent to shatterproof1 (SHELL) shell thickness gene
gagaaaacgggactgggacaaggtygggactccgaaacccatctacacaa

SEQ ID NO: 4813 - DNA, 50 bp, Artificial Sequence
  synthetic Elaeis guineensis (oil palm) single nucleotide polymorphism (SNP) in genomic region adjacent to shatterproof1 (SHELL) shell thickness gene
gacagggggtgtcccggccgtcccrtccgttcctatgagaaaacgggact

SEQ ID NO: 4814 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggaataacgaagaataacagcaagscttctctaaactaaaacaaataccg

SEQ ID NO: 4815 - DNA, 50 bp, Artificial Sequence
  synthetic Elaeis guineensis (oil palm) single nucleotide polymorphism (SNP) in genomic region adjacent to shatterproof1 (SHELL) shell thickness gene
taacatctactctatctcatggatwagtattacctagttttttgtcacct

SEQ ID NO: 4816 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaagcacacatttctctttttcttycatctgaaattctaacatctactct

SEQ ID NO: 4817 - DNA, 50 bp, Artificial Sequence
  synthetic Elaeis guineensis (oil palm) single nucleotide polymorphism (SNP) in genomic region adjacent to shatterproof1 (SHELL) shell thickness gene
atggtatttaggcatgcataagaaycataaaatcaataaaattacaatgg

SEQ ID NO: 4818 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctttatatggtatttaggcatgcawaagaatcataaaatcaataaaatta

SEQ ID NO: 4819 - DNA, 50 bp, Artificial Sequence
  synthetic Elaeis guineensis (oil palm) single nucleotide polymorphism (SNP) in genomic region adjacent to shatterproof1 (SHELL) shell thickness gene
gggaactatcttctagcatggatgytacttagctttaacaaaaaaatgtt

SEQ ID NO: 4820 - DNA, 50 bp, Artificial Sequence
  synthetic Elaeis guineensis (oil palm) single nucleotide polymorphism (SNP) in genomic region adjacent to shatterproof1 (SHELL) shell thickness gene
accaagggaggctggctcaaacaawtagaaaaggcaacactcaacacaaa

SEQ ID NO: 4821 - DNA, 50 bp, Artificial Sequence
  synthetic Elaeis guineensis (oil palm) single nucleotide polymorphism (SNP) in genomic region adjacent to shatterproof1 (SHELL) shell thickness gene
gggaatccttaaccaagggaggctsgctcaaacaattagaaaaggcaaca

SEQ ID NO: 4822 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttataattttggttgaagtcagcwacaggaggccctctcttcctctccc

SEQ ID NO: 4823 - DNA, 50 bp, Artificial Sequence
  synthetic Elaeis guineensis (oil palm) single nucleotide polymorphism (SNP) in genomic region adjacent to shatterproof1 (SHELL) shell thickness gene
gagggcctctaccctcctctcgtgygaaacagggattcaatcttattttg

SEQ ID NO: 4824 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggagagggagaggaagagaggcgcyggaggccaccgaaggacctgagggc

SEQ ID NO: 4825 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgctggtcggctgatggtatggttyggtacagatttgtaacgttctgtgc

SEQ ID NO: 4826 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagcaaggaccactaaatcggaacyggaatcggagctcgtgctggtcggc

SEQ ID NO: 4827 - DNA, 50 bp, Artificial Sequence
  synthetic Elaeis guineensis (oil palm) single nucleotide polymorphism (SNP) in genomic region adjacent to shatterproof1 (SHELL) shell thickness gene
atagaagccataaaagcaaggaccrctaaatcggaaccggaatcggagct

SEQ ID NO: 4828 - DNA, 50 bp, Artificial Sequence
  synthetic Elaeis guineensis (oil palm) single nucleotide polymorphism (SNP) in genomic region adjacent to shatterproof1 (SHELL) shell thickness gene
taagataaggtcttgaagaaattaratataaagttttactaagtacttaa

SEQ ID NO: 4829 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcattaacaagctagaagaattgcwtcatgaaataagataaggtcttgaa

SEQ ID NO: 4830 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttagacaactccatgcacttcccarggaaaaaaataaataaataaacact

SEQ ID NO: 4831 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctgctgataagacgtactattagrcaactccatgcacttcccagggaaa

SEQ ID NO: 4832 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctgctgctgtgaggcaaggcttgaygatatatgctcagcaaattctttga

SEQ ID NO: 4833 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaagaactagctgctgctgtgaggyaaggcttgacgatatatgctcagca

SEQ ID NO: 4834 - DNA, 50 bp, Artificial Sequence
  synthetic Elaeis guineensis (oil palm) single nucleotide polymorphism (SNP) in genomic region adjacent to shatterproof1 (SHELL) shell thickness gene
atgaaaatgatttttggacttgacraagttctgatgcattttcgttctcc

SEQ ID NO: 4835 - DNA, 50 bp, Artificial Sequence
  synthetic Elaeis guineensis (oil palm) single nucleotide polymorphism (SNP) in genomic region adjacent to shatterproof1 (SHELL) shell thickness gene
caatcactggctttaccatgggacmaggtacaataggtagaacacctgcg

SEQ ID NO: 4836 - DNA, 50 bp, Artificial Sequence
  synthetic Elaeis guineensis (oil palm) single nucleotide polymorphism (SNP) in genomic region adjacent to shatterproof1 (SHELL) shell thickness gene
catacataaaaaaactagtaaaggygcctcattgggaggggagattaccc

SEQ ID NO: 4837 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttaatttgttgaaaagaatctgtaygtgaaaacgcacaactgcatgtctt

SEQ ID NO: 4838 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctttaatttgttgaaaagaatctgwacgtgaaaacgcacaactgcatgtc

SEQ ID NO: 4839 - DNA, 50 bp, Artificial Sequence
  synthetic Elaeis guineensis (oil palm) single nucleotide polymorphism (SNP) in genomic region adjacent to shatterproof1 (SHELL) shell thickness gene
atgacacaattcctcctctgagagraaaagacaaattacctgtcagatca

SEQ ID NO: 4840 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtgttgatgacacaattcctcctcygagaggaaaagacaaattacctgtc

SEQ ID NO: 4841 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttacaaagaaaagcaacaaaatakggtcctcaaaatccactaatcgatg

SEQ ID NO: 4842 - DNA, 50 bp, Artificial Sequence
  synthetic Elaeis guineensis (oil palm) single nucleotide polymorphism (SNP) in genomic region adjacent to shatterproof1 (SHELL) shell thickness gene
aggcggcctatttaagagtatgacrggtttctggaacttgtttcttctaa

SEQ ID NO: 4843 - DNA, 50 bp, Artificial Sequence
  synthetic Elaeis guineensis (oil palm) single nucleotide polymorphism (SNP) in genomic region adjacent to shatterproof1 (SHELL) shell thickness gene
gagatgctgaagtttcagaatgtcygcattattacatgagccatgtaaga

SEQ ID NO: 4844 - DNA, 50 bp, Artificial Sequence
  synthetic Elaeis guineensis (oil palm) single nucleotide polymorphism (SNP) in genomic region adjacent to shatterproof1 (SHELL) shell thickness gene
taagaacagattaggaagagatgcygaagtttcagaatgtctgcattatt

SEQ ID NO: 4845 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcctcctggagctttgggctaagtkttccctttctgtatgtacattaata

SEQ ID NO: 4846 - DNA, 50 bp, Artificial Sequence
  synthetic Elaeis guineensis (oil palm) single nucleotide polymorphism (SNP) in genomic region adjacent to shatterproof1 (SHELL) shell thickness gene
tataaacaagacaacgaaccttagkacttcatcctcctggagctttgggc

SEQ ID NO: 4847 - DNA, 50 bp, Artificial Sequence
  synthetic Elaeis guineensis (oil palm) single nucleotide polymorphism (SNP) in genomic region adjacent to shatterproof1 (SHELL) shell thickness gene
tccgatgtcatgaacataggttgtkaatccatcataaccaatatattttt

SEQ ID NO: 4848 - DNA, 50 bp, Artificial Sequence
  synthetic Elaeis guineensis (oil palm) single nucleotide polymorphism (SNP) in genomic region adjacent to shatterproof1 (SHELL) shell thickness gene
catatagatgtctattgtgcggcasgcataaatattgttatatttatccc

SEQ ID NO: 4849 - DNA, 50 bp, Artificial Sequence
  synthetic Elaeis guineensis (oil palm) single nucleotide polymorphism (SNP) in genomic region adjacent to shatterproof1 (SHELL) shell thickness gene
acatatagatgtctattgtgcggcmggcataaatattgttatatttatcc

SEQ ID NO: 4850 - DNA, 50 bp, Artificial Sequence
  synthetic Elaeis guineensis (oil palm) single nucleotide polymorphism (SNP) in genomic region adjacent to shatterproof1 (SHELL) shell thickness gene
tacttcatcgattaggtttaacatrtagatgtctattgtgcggcaggcat

SEQ ID NO: 4851 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttttttcttcattttttctgttggytctgatttttctattggaagcttat

SEQ ID NO: 4852 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttttttttcttcattttttctgttrgctctgatttttctattggaagctt

SEQ ID NO: 4853 - DNA, 50 bp, Artificial Sequence
  synthetic Elaeis guineensis (oil palm) single nucleotide polymorphism (SNP) in genomic region adjacent to shatterproof1 (SHELL) shell thickness gene
agatttcgagctgcgagacttattrtcttaatctaccaactactacatgt

SEQ ID NO: 4854 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaaaatcccgacagaaaagtttggrtcgggtctcaattgcccgacaccga

SEQ ID NO: 4855 - DNA, 50 bp, Artificial Sequence
  synthetic Elaeis guineensis (oil palm) single nucleotide polymorphism (SNP) in genomic region adjacent to shatterproof1 (SHELL) shell thickness gene
agcacagtctccctcattttcgcgrtcgtccaagttccttcggcctacaa

SEQ ID NO: 4856 - DNA, 50 bp, Artificial Sequence
  synthetic Elaeis guineensis (oil palm) single nucleotide polymorphism (SNP) in genomic region adjacent to shatterproof1 (SHELL) shell thickness gene
cgtgacggtcggtaccgaaccacgrcaaagcacagtctccctcattttcg

SEQ ID NO: 4857 - DNA, 50 bp, Artificial Sequence
  synthetic Elaeis guineensis (oil palm) single nucleotide polymorphism (SNP) in genomic region adjacent to shatterproof1 (SHELL) shell thickness gene
cggctaccgactgatcgacttagtrgggtctccacgcccttgatcggctt

SEQ ID NO: 4858 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttactcgatcttctcccgaatgcgrctaccgactgatcgacttagtaggg

SEQ ID NO: 4859 - DNA, 50 bp, Artificial Sequence
  synthetic Elaeis guineensis (oil palm) single nucleotide polymorphism (SNP) in genomic region adjacent to shatterproof1 (SHELL) shell thickness gene
cgacaaatattttgttttactcgaycttctcccgaatgcggctaccgact

SEQ ID NO: 4860 - DNA, 50 bp, Artificial Sequence
  synthetic Elaeis guineensis (oil palm) single nucleotide polymorphism (SNP) in genomic region adjacent to shatterproof1 (SHELL) shell thickness gene
gttgataacggaagttcgacaaatrttttgttttactcgatcttctcccg

SEQ ID NO: 4861 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgtaaaacgaatttttgttgataayggaagttcgacaaatattttgtttt

SEQ ID NO: 4862 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtgattaccttctcagaagacgacrttcggggcatccagactccccacga

SEQ ID NO: 4863 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggacgtctacagggggggagccgaygaaaaagccgcgcccggacgacgtg

SEQ ID NO: 4864 - DNA, 50 bp, Artificial Sequence
  synthetic Elaeis guineensis (oil palm) single nucleotide polymorphism (SNP) in genomic region adjacent to shatterproof1 (SHELL) shell thickness gene
agtcatcaacatgatctccaagcgrctgggatcggggacgtctacagggg

SEQ ID NO: 4865 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggcgccgactaaccagccgacggckggagtcatcaacatgatctccaagc

SEQ ID NO: 4866 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttcgaaaaggtccgccgacccgaycggctgccgatcgatgcccccagcc

SEQ ID NO: 4867 - DNA, 50 bp, Artificial Sequence
  synthetic Elaeis guineensis (oil palm) single nucleotide polymorphism (SNP) in genomic region adjacent to shatterproof1 (SHELL) shell thickness gene
cgagcgatgcatccagttgaaggaygagatcgaaaatctcatccgccggg

SEQ ID NO: 4868 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaagaatacctgcgacggcctccgyctctgaaggcaaagggcctcgacca

SEQ ID NO: 4869 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcaccccgccgacaaactccgaggycggtgcgtcccaggtatgactccta

SEQ ID NO: 4870 - DNA, 50 bp, Artificial Sequence
  synthetic Elaeis guineensis (oil palm) single nucleotide polymorphism (SNP) in genomic region adjacent to shatterproof1 (SHELL) shell thickness gene
gatccaaaaatcaccccgccgacaractccgaggccggtgcgtcccaggt

SEQ ID NO: 4871 - DNA, 50 bp, Artificial Sequence
  synthetic Elaeis guineensis (oil palm) single nucleotide polymorphism (SNP) in genomic region adjacent to shatterproof1 (SHELL) shell thickness gene
accccgacagatccaaaaatcaccycgccgacaaactccgaggccggtgc

SEQ ID NO: 4872 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggagcccgccgaaccaagcaggccyccggccaatagtcggctttctccac

SEQ ID NO: 4873 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagcattgatgcgaatcaattagcytgaccacgatccaagtttggtagga

SEQ ID NO: 4874 - DNA, 50 bp, Artificial Sequence
  synthetic Elaeis guineensis (oil palm) single nucleotide polymorphism (SNP) in genomic region adjacent to shatterproof1 (SHELL) shell thickness gene
atacaataaatagagagattgatgwggaaaagagtgtattggaaaatgga

SEQ ID NO: 4875 - DNA, 50 bp, Artificial Sequence
  synthetic Elaeis guineensis (oil palm) single nucleotide polymorphism (SNP) in genomic region adjacent to shatterproof1 (SHELL) shell thickness gene
acacaaatttgtaggtatgacatayaataaatagagagattgatgaggaa

SEQ ID NO: 4876 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttccatcaaatcatgccattactargaactggtcattaaatcagataaaa

SEQ ID NO: 4877 - DNA, 50 bp, Artificial Sequence
  synthetic Elaeis guineensis (oil palm) single nucleotide polymorphism (SNP) in genomic region adjacent to shatterproof1 (SHELL) shell thickness gene
actttaattgttgttttcaaaaatrttgacgaaaaattctaatacaattc

SEQ ID NO: 4878 - DNA, 50 bp, Artificial Sequence
  synthetic Elaeis guineensis (oil palm) single nucleotide polymorphism (SNP) in genomic region adjacent to shatterproof1 (SHELL) shell thickness gene
atacgtggtaagtcattgggccatrttttttcgacctctcccttccaacc

SEQ ID NO: 4879 - DNA, 50 bp, Artificial Sequence
  synthetic Elaeis guineensis (oil palm) single nucleotide polymorphism (SNP) in genomic region adjacent to shatterproof1 (SHELL) shell thickness gene
catgatccaacaatccatattttgrctgctgacttctctatcaatggccg

SEQ ID NO: 4880 - DNA, 50 bp, Artificial Sequence
  synthetic Elaeis guineensis (oil palm) single nucleotide polymorphism (SNP) in genomic region adjacent to shatterproof1 (SHELL) shell thickness gene
atcattaatcctcgtatcagccgcygacctaaacataattttttgacttc

SEQ ID NO: 4881 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaatcaaaaagtatattaattttgrcaatactattcaatagacatgccat

SEQ ID NO: 4882 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaatttttttatttgagcttgagtyctctactgtgcaccgtaaaatatga

SEQ ID NO: 4883 - DNA, 50 bp, Artificial Sequence
  synthetic Elaeis guineensis (oil palm) single nucleotide polymorphism (SNP) in genomic region adjacent to shatterproof1 (SHELL) shell thickness gene
atccctttttagctggttaccaaamaaaatccctctttagctccattgaa

SEQ ID NO: 4884 - DNA, 50 bp, Artificial Sequence
  synthetic Elaeis guineensis (oil palm) single nucleotide polymorphism (SNP) in genomic region adjacent to shatterproof1 (SHELL) shell thickness gene
gagcctcctgctccttctctctcarcgagtagtctctctctcttctcgag

SEQ ID NO: 4885 - DNA, 50 bp, Artificial Sequence
  synthetic Elaeis guineensis (oil palm) single nucleotide polymorphism (SNP) in genomic region adjacent to shatterproof1 (SHELL) shell thickness gene
gatctctccctcaactcttatacayccaatttttctctcctgaagttctc

SEQ ID NO: 4886 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaggagatctctccctcaactcttrtacatccaatttttctctcctgaag

SEQ ID NO: 4887 - DNA, 50 bp, Artificial Sequence
  synthetic Elaeis guineensis (oil palm) single nucleotide polymorphism (SNP) in genomic region adjacent to shatterproof1 (SHELL) shell thickness gene
gggtgaaaaaatttcttacagggtyctttcagagccaacatccaagcttg

SEQ ID NO: 4888 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtagatccaaaaatattgcgcttgrccacaaatagaattgtagattcaaa

SEQ ID NO: 4889 - DNA, 50 bp, Artificial Sequence
  synthetic Elaeis guineensis (oil palm) single nucleotide polymorphism (SNP) in genomic region adjacent to shatterproof1 (SHELL) shell thickness gene
ataaatccaaggaaatcaacttgtrtagtatcagatcttatgcttggcaa

SEQ ID NO: 4890 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggatatgacggtcaaattcaaatakataaatccaaggaaatcaacttgta

SEQ ID NO: 4891 - DNA, 50 bp, Artificial Sequence
  synthetic Elaeis guineensis (oil palm) single nucleotide polymorphism (SNP) in genomic region adjacent to shatterproof1 (SHELL) shell thickness gene
cttagaggagtttgtgggatatgayggtcaaattcaaatatataaatcca

SEQ ID NO: 4892 - DNA, 50 bp, Artificial Sequence
  synthetic Elaeis guineensis (oil palm) single nucleotide polymorphism (SNP) in genomic region adjacent to shatterproof1 (SHELL) shell thickness gene
atttgtcagaaactcgtagtataaraaggattattcacttcccatgaaat

SEQ ID NO: 4893 - DNA, 50 bp, Artificial Sequence
  synthetic Elaeis guineensis (oil palm) single nucleotide polymorphism (SNP) in genomic region adjacent to shatterproof1 (SHELL) shell thickness gene
agtccatgcttcataatgcatcagsaaaaatcaatccaatagtgtatact

SEQ ID NO: 4894 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatatcccagcaatttcgtaacttyttttattttccaaaatttgccatgt

SEQ ID NO: 4895 - DNA, 50 bp, Artificial Sequence
  synthetic Elaeis guineensis (oil palm) single nucleotide polymorphism (SNP) in genomic region adjacent to shatterproof1 (SHELL) shell thickness gene
atgtgaatacatcttatgcatacayatacaatatcccagcaatttcgtaa

SEQ ID NO: 4896 - DNA, 50 bp, Artificial Sequence
  synthetic Elaeis guineensis (oil palm) single nucleotide polymorphism (SNP) in genomic region adjacent to shatterproof1 (SHELL) shell thickness gene
gttcataatgttgagttactttatraagtatggaatgtagtctatgcatt

SEQ ID NO: 4897 - DNA, 50 bp, Artificial Sequence
  synthetic Elaeis guineensis (oil palm) single nucleotide polymorphism (SNP) in genomic region adjacent to shatterproof1 (SHELL) shell thickness gene
caaaacatataggatgcgaatgctsgcgatagacatagccagaatatgtg

SEQ ID NO: 4898 - DNA, 50 bp, Artificial Sequence
  synthetic Elaeis guineensis (oil palm) single nucleotide polymorphism (SNP) in genomic region adjacent to shatterproof1 (SHELL) shell thickness gene
cttcgagtgcacataatccatacawtgtcattagctacattaaaatgtag

SEQ ID NO: 4899 - DNA, 50 bp, Artificial Sequence
  synthetic Elaeis guineensis (oil palm) single nucleotide polymorphism (SNP) in genomic region adjacent to shatterproof1 (SHELL) shell thickness gene
gagatttcacagttagaagacttckagtgcacataatccatacaatgtca

SEQ ID NO: 4900 - DNA, 50 bp, Artificial Sequence
  synthetic Elaeis guineensis (oil palm) single nucleotide polymorphism (SNP) in genomic region adjacent to shatterproof1 (SHELL) shell thickness gene
atgacaggcaattaatgacagttcrgaataagacacttgattataaagaa

SEQ ID NO: 4901 - DNA, 50 bp, Artificial Sequence
  synthetic Elaeis guineensis (oil palm) single nucleotide polymorphism (SNP) in genomic region adjacent to shatterproof1 (SHELL) shell thickness gene
taaagtagatccataagatcctgcragacataccatgaaaaatcatatac

SEQ ID NO: 4902 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttaccaatagcttttatacgctcyacgctcttgtaccttaaagtagatc

SEQ ID NO: 4903 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccatctactcttcaaggatacagcrtgatattaagacgatcaagtaagat

SEQ ID NO: 4904 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatatataaatgtgaaattgaggtmattgtataagaaagaggggccacat

SEQ ID NO: 4905 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgcaagtacaataatgtaatctaayagaatctaacaatggaccatggtaa

SEQ ID NO: 4906 - DNA, 50 bp, Artificial Sequence
  synthetic Elaeis guineensis (oil palm) single nucleotide polymorphism (SNP) in genomic region adjacent to shatterproof1 (SHELL) shell thickness gene
tattaaaaatgataaacagactccyaaaaaaatgatttgtcctaggaaaa

SEQ ID NO: 4907 - DNA, 50 bp, Artificial Sequence
  synthetic Elaeis guineensis (oil palm) single nucleotide polymorphism (SNP) in genomic region adjacent to shatterproof1 (SHELL) shell thickness gene
aacaactctagctaaaatatgcctwtattatatgtccaaaccctataaca

SEQ ID NO: 4908 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatattcaccctattcttcctcaargtaaaggagagaccgaaaatggtac

SEQ ID NO: 4909 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtaaatattcaccctattcttcctmaaggtaaaggagagaccgaaaatgg

SEQ ID NO: 4910 - DNA, 50 bp, Artificial Sequence
  synthetic Elaeis guineensis (oil palm) single nucleotide polymorphism (SNP) in genomic region adjacent to shatterproof1 (SHELL) shell thickness gene
taatactttcattgtctttgattarttgttcattgacgacttatatcaat

SEQ ID NO: 4911 - DNA, 50 bp, Artificial Sequence
  synthetic Elaeis guineensis (oil palm) single nucleotide polymorphism (SNP) in genomic region adjacent to shatterproof1 (SHELL) shell thickness gene
aattggtagaaggatttaaagagtwatcggcatatgattttcattggcct

SEQ ID NO: 4912 - DNA, 50 bp, Artificial Sequence
  synthetic Elaeis guineensis (oil palm) single nucleotide polymorphism (SNP) in genomic region adjacent to shatterproof1 (SHELL) shell thickness gene
attatattagtatattaacaatgaraaagcatccgaatatatggagtgtt

SEQ ID NO: 4913 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaccgcaaggacgatggctgttcracaaatgaggggttccaaagggtgc

SEQ ID NO: 4914 - DNA, 50 bp, Artificial Sequence
  synthetic Elaeis guineensis (oil palm) single nucleotide polymorphism (SNP) in genomic region adjacent to shatterproof1 (SHELL) shell thickness gene
tggtatattggaattatttgcatcrgtgatctcatcaagttggttggcag

SEQ ID NO: 4915 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcaatccaaaataaaacccgtcaamaacggcatcatcgtgacaacaacta

SEQ ID NO: 4916 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaggtagcggtccttcttctcgaytcataggagtttggatcggggcttg

SEQ ID NO: 4917 - DNA, 50 bp, Artificial Sequence
  synthetic Elaeis guineensis (oil palm) single nucleotide polymorphism (SNP) in genomic region adjacent to shatterproof1 (SHELL) shell thickness gene
gagcagaagggggtcttggtccagsccagttttgaggattgcggcatgga

SEQ ID NO: 4918 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcagcgaccgcatctctctcaggcrtttcaccaaaaacccatccggcatc

SEQ ID NO: 4919 - DNA, 50 bp, Artificial Sequence
  synthetic Elaeis guineensis (oil palm) single nucleotide polymorphism (SNP) in genomic region adjacent to shatterproof1 (SHELL) shell thickness gene
agctccaatgcacccaactgagagmaagccgatagaacacaaacgacagt

SEQ ID NO: 4920 - DNA, 50 bp, Artificial Sequence
  synthetic Elaeis guineensis (oil palm) single nucleotide polymorphism (SNP) in genomic region adjacent to shatterproof1 (SHELL) shell thickness gene
caaaattccagccaccttctctccwagggtcaagtttccatggatcttac

SEQ ID NO: 4921 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttttcccctagcactcactgccttytcccatttcccgaatgaggcataaa

SEQ ID NO: 4922 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttttcccctagcactcactgcctyttcccatttcccgaatgaggcataa

SEQ ID NO: 4923 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctgaggttcttcacaactcgtatygtcgttcctggtttagttgagataa

SEQ ID NO: 4924 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttacagttccacaggttttgcatayctgatcaatccactcaatctttcgc

SEQ ID NO: 4925 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgaaattcaattacagttccacagrttttgcatatctgatcaatccactc

SEQ ID NO: 4926 - DNA, 50 bp, Artificial Sequence
  synthetic Elaeis guineensis (oil palm) single nucleotide polymorphism (SNP) in genomic region adjacent to shatterproof1 (SHELL) shell thickness gene
atgaacaacattgttatcacatacrgtaaggttcttgaatgaaattcaat

SEQ ID NO: 4927 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagcaattgatgagaaaagtatttyatgacccatataacagcaaatggaa

SEQ ID NO: 4928 - DNA, 50 bp, Artificial Sequence
  synthetic Elaeis guineensis (oil palm) single nucleotide polymorphism (SNP) in genomic region adjacent to shatterproof1 (SHELL) shell thickness gene
catgcgtggtgcaagcaattgatgrgaaaagtatttcatgacccatataa

SEQ ID NO: 4929 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcagttaagttggatgtttgaaackgtaactcatacttcatatgcatgcg

SEQ ID NO: 4930 - DNA, 50 bp, Artificial Sequence
  synthetic Elaeis guineensis (oil palm) single nucleotide polymorphism (SNP) in genomic region adjacent to shatterproof1 (SHELL) shell thickness gene
acgttcactgtattcctaacacctmtaagatcctaggcatccaataggtg

SEQ ID NO: 4931 - DNA, 50 bp, Artificial Sequence
  synthetic Elaeis guineensis (oil palm) single nucleotide polymorphism (SNP) in genomic region adjacent to shatterproof1 (SHELL) shell thickness gene
cacacgttcactgtattcctaacasctataagatcctaggcatccaatag

SEQ ID NO: 4932 - DNA, 50 bp, Artificial Sequence
  synthetic Elaeis guineensis (oil palm) single nucleotide polymorphism (SNP) in genomic region adjacent to shatterproof1 (SHELL) shell thickness gene
atttttaggtacaagattggtcatytggtatttagtatttgggtcttata

SEQ ID NO: 4933 - DNA, 50 bp, Artificial Sequence
  synthetic Elaeis guineensis (oil palm) single nucleotide polymorphism (SNP) in genomic region adjacent to shatterproof1 (SHELL) shell thickness gene
agctcgtttttaggtgctttgagtsattgagtgcttcaataaatatcaca

SEQ ID NO: 4934 - DNA, 50 bp, Artificial Sequence
  synthetic Elaeis guineensis (oil palm) single nucleotide polymorphism (SNP) in genomic region adjacent to shatterproof1 (SHELL) shell thickness gene
cttaacttctgaataatgaatactraaagagttcagaagtaacaagattt

SEQ ID NO: 4935 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcagattcatggatgagaatgcaaragtcttaacttctgaataatgaata

SEQ ID NO: 4936 - DNA, 50 bp, Artificial Sequence
  synthetic Elaeis guineensis (oil palm) single nucleotide polymorphism (SNP) in genomic region adjacent to shatterproof1 (SHELL) shell thickness gene
gatctcatctttaggtagaaaggayggaaaagaggaccataaaaacctgg

SEQ ID NO: 4937 - DNA, 50 bp, Artificial Sequence
  synthetic Elaeis guineensis (oil palm) single nucleotide polymorphism (SNP) in genomic region adjacent to shatterproof1 (SHELL) shell thickness gene
tggattgactaggggtgacagaaaycagcaaagctgaggtgactgtgtga

SEQ ID NO: 4938 - DNA, 50 bp, Artificial Sequence
  synthetic Elaeis guineensis (oil palm) single nucleotide polymorphism (SNP) in genomic region adjacent to shatterproof1 (SHELL) shell thickness gene
ataagcttttcatcaatatgcagtrgggcctatttttgaattgatcttat

SEQ ID NO: 4939 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggtccatagcgaagttgctggattygataaatataaattaagatttatgc

SEQ ID NO: 4940 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggtctgagctggggaggaatgtccrgtactctgcctgcaatgactttttg

SEQ ID NO: 4941 - DNA, 50 bp, Artificial Sequence
  synthetic Elaeis guineensis (oil palm) single nucleotide polymorphism (SNP) in genomic region adjacent to shatterproof1 (SHELL) shell thickness gene
atatttttttcctatccgtgattaktttggtagggattgctgaaatgaaa

SEQ ID NO: 4942 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctacagcaccacgtaagtccaaatycaactaacccattacatgagttttg

SEQ ID NO: 4943 - DNA, 50 bp, Artificial Sequence
  synthetic Elaeis guineensis (oil palm) single nucleotide polymorphism (SNP) in genomic region adjacent to shatterproof1 (SHELL) shell thickness gene
cacattttcagaacaccttagaaawaaattctgaaaaaatgtcactaccc

SEQ ID NO: 4944 - DNA, 50 bp, Artificial Sequence
  synthetic Elaeis guineensis (oil palm) single nucleotide polymorphism (SNP) in genomic region adjacent to shatterproof1 (SHELL) shell thickness gene
cattggattgtgaatgagaaagctytgaacccaacagtaggcttgagact

SEQ ID NO: 4945 - DNA, 50 bp, Artificial Sequence
  synthetic Elaeis guineensis (oil palm) single nucleotide polymorphism (SNP) in genomic region adjacent to shatterproof1 (SHELL) shell thickness gene
agctttgaacccaacagtaggcttragactagagaattttcactaccaga

SEQ ID NO: 4946 - DNA, 50 bp, Artificial Sequence
  synthetic Elaeis guineensis (oil palm) single nucleotide polymorphism (SNP) in genomic region adjacent to shatterproof1 (SHELL) shell thickness gene
cattggacgtcctcagttgtggacmactgctaatcatggaattcagcttt

SEQ ID NO: 4947 - DNA, 50 bp, Artificial Sequence
  synthetic Elaeis guineensis (oil palm) single nucleotide polymorphism (SNP) in genomic region adjacent to shatterproof1 (SHELL) shell thickness gene
gacgtcctcagttgtggacaactgmtaatcatggaattcagctttatata

SEQ ID NO: 4948 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctaatgtcctcgtgttggttacccyctttgtttttctcgtttgtttaggc

SEQ ID NO: 4949 - DNA, 50 bp, Artificial Sequence
  synthetic Elaeis guineensis (oil palm) single nucleotide polymorphism (SNP) in genomic region adjacent to shatterproof1 (SHELL) shell thickness gene
attttatgtctaggagctttagtargttgtagcattttgtttgataagct

SEQ ID NO: 4950 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccttcctcctggcaaatgtagttgrgcctgattttggcatcctaatgtga

SEQ ID NO: 4951 - DNA, 50 bp, Artificial Sequence
  synthetic Elaeis guineensis (oil palm) single nucleotide polymorphism (SNP) in genomic region adjacent to shatterproof1 (SHELL) shell thickness gene
tattctgcttctttcatgctgaagygtataggaggcctttccttgcttcc

SEQ ID NO: 4952 - DNA, 50 bp, Artificial Sequence
  synthetic Elaeis guineensis (oil palm) single nucleotide polymorphism (SNP) in genomic region adjacent to shatterproof1 (SHELL) shell thickness gene
attccaaaatggttggactggaatrattaaattctatcttgattgcatac

SEQ ID NO: 4953 - DNA, 50 bp, Artificial Sequence
  synthetic Elaeis guineensis (oil palm) single nucleotide polymorphism (SNP) in genomic region adjacent to shatterproof1 (SHELL) shell thickness gene
atctgcccaattaaaatgagaaaamaatataaaataatgacaaattaaat

SEQ ID NO: 4954 - DNA, 50 bp, Artificial Sequence
  synthetic Elaeis guineensis (oil palm) single nucleotide polymorphism (SNP) in genomic region adjacent to shatterproof1 (SHELL) shell thickness gene
gatgaataaaaatatagaccaatgrattgcaaaaaggttcaaccggaaat

SEQ ID NO: 4955 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcttgaaagtaaaaataaaatataratcaaagaaaccattttaagtagaa

SEQ ID NO: 4956 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctatggatcataataacccaagtaytaatttgtccatatatgtatcgaaa

SEQ ID NO: 4957 - DNA, 50 bp, Artificial Sequence
  synthetic Elaeis guineensis (oil palm) single nucleotide polymorphism (SNP) in genomic region adjacent to shatterproof1 (SHELL) shell thickness gene
ataacccaagtattaatttgtccayatatgtatcgaaaaataggtttcgc

SEQ ID NO: 4958 - DNA, 50 bp, Artificial Sequence
  synthetic Elaeis guineensis (oil palm) single nucleotide polymorphism (SNP) in genomic region adjacent to shatterproof1 (SHELL) shell thickness gene
atatatgtatcgaaaaataggtttygcatctagactcgataatgatccta

SEQ ID NO: 4959 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatatgtatcgaaaaataggtttcrcatctagactcgataatgatcctaa

SEQ ID NO: 4960 - DNA, 50 bp, Artificial Sequence
  synthetic Elaeis guineensis (oil palm) single nucleotide polymorphism (SNP) in genomic region adjacent to shatterproof1 (SHELL) shell thickness gene
ataggctgtgttgcaatgatttttytgaaaaacaattaactattggatca

SEQ ID NO: 4961 - DNA, 50 bp, Artificial Sequence
  synthetic Elaeis guineensis (oil palm) single nucleotide polymorphism (SNP) in genomic region adjacent to shatterproof1 (SHELL) shell thickness gene
attaactattggatcagccttaaawttaaacttgaataagtcgaactgtc

SEQ ID NO: 4962 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaatcaatagtaatcacatggattrtagtgaacggtacagagccaataaa

SEQ ID NO: 4963 - DNA, 50 bp, Artificial Sequence
  synthetic Elaeis guineensis (oil palm) single nucleotide polymorphism (SNP) in genomic region adjacent to shatterproof1 (SHELL) shell thickness gene
cagagccaataaactggcacttagktatgagaaacaattacgtggattac

SEQ ID NO: 4964 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctaaccatttaatgtgatcgagtrtggcaatcattggcacccgcgaatt

SEQ ID NO: 4965 - DNA, 50 bp, Artificial Sequence
  synthetic Elaeis guineensis (oil palm) single nucleotide polymorphism (SNP) in genomic region adjacent to shatterproof1 (SHELL) shell thickness gene
atgtgtgcaaaaaattcatttccawcactcttcttgattgaaactcctct

SEQ ID NO: 4966 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtggtcaaatctttatctatctgcmtcccactgaacttaggatgggacct

SEQ ID NO: 4967 - DNA, 50 bp, Artificial Sequence
  synthetic Elaeis guineensis (oil palm) single nucleotide polymorphism (SNP) in genomic region adjacent to shatterproof1 (SHELL) shell thickness gene
acctttgtattttgcaagcatgagygaacctgacataaacgtcttggttg

SEQ ID NO: 4968 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggcctcccactgacatgaatagccragtaatgaaaaagactaatgcaacc

SEQ ID NO: 4969 - DNA, 50 bp, Artificial Sequence
  synthetic Elaeis guineensis (oil palm) single nucleotide polymorphism (SNP) in genomic region adjacent to shatterproof1 (SHELL) shell thickness gene
cttctatagtggcagaccggcaggktatctgacgttcttgcattaatgat

SEQ ID NO: 4970 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgccaccttgtgttttcgtttcatyggagttgattcagattttcttttgt

SEQ ID NO: 4971 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaatcatctcattgatattgtgaamtgaagatctcaagtttaagaatcaa

SEQ ID NO: 4972 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgaagatctcaagtttaagaatcaraaaaggagaaaaaaaagctttctaa

SEQ ID NO: 4973 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccattccaccagataggtatgaagrgaaagtttcattatgctttccactc

SEQ ID NO: 4974 - DNA, 50 bp, Artificial Sequence
  synthetic Elaeis guineensis (oil palm) single nucleotide polymorphism (SNP) in genomic region adjacent to shatterproof1 (SHELL) shell thickness gene
cagttttttgggattgtgtgctccrtacctggccatataaagtatgaaca

SEQ ID NO: 4975 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcatattattttctgttttatatcyttctaatatttcattcccattttgc

SEQ ID NO: 4976 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctttccttaaataactgactgagrctcccattcttttgctgggtctctc

SEQ ID NO: 4977 - DNA, 50 bp, Artificial Sequence
  synthetic Elaeis guineensis (oil palm) single nucleotide polymorphism (SNP) in genomic region adjacent to shatterproof1 (SHELL) shell thickness gene
acttatatttttactgactaattgytaatcaaaatgctgctgattaattg

SEQ ID NO: 4978 - DNA, 50 bp, Artificial Sequence
  synthetic Elaeis guineensis (oil palm) single nucleotide polymorphism (SNP) in genomic region adjacent to shatterproof1 (SHELL) shell thickness gene
tggagctgttggagatggagtgacrcttaacactaaagcatttcaaaatg

SEQ ID NO: 4979 - DNA, 50 bp, Artificial Sequence
  synthetic Elaeis guineensis (oil palm) single nucleotide polymorphism (SNP) in genomic region adjacent to shatterproof1 (SHELL) shell thickness gene
agggtaaagaagcatttcatcgttktcaaggttgacatctgatctgcaat

SEQ ID NO: 4980 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaggagaggctttactggaactttrtcatgaacattgttctatatcacaa

SEQ ID NO: 4981 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttgtcatgaacattgttctatatyacaatttgatccaatcagtggattt

SEQ ID NO: 4982 - DNA, 50 bp, Artificial Sequence
  synthetic Elaeis guineensis (oil palm) single nucleotide polymorphism (SNP) in genomic region adjacent to shatterproof1 (SHELL) shell thickness gene
caaagatgctattcttagctttgtsatatgttttcttataaaaatatagc

SEQ ID NO: 4983 - DNA, 50 bp, Artificial Sequence
  synthetic Elaeis guineensis (oil palm) single nucleotide polymorphism (SNP) in genomic region adjacent to shatterproof1 (SHELL) shell thickness gene
agctttgtgatatgttttcttatawaaatatagcagagagtctttttaaa

SEQ ID NO: 4984 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcctacctttttttactgtccattkacaaagccagaagttttttcttcgc

SEQ ID NO: 4985 - DNA, 50 bp, Artificial Sequence
  synthetic Elaeis guineensis (oil palm) single nucleotide polymorphism (SNP) in genomic region adjacent to shatterproof1 (SHELL) shell thickness gene
caggtttgttgattttagccagackaaacttggaggtactctagccattg

SEQ ID NO: 4986 - DNA, 50 bp, Artificial Sequence
  synthetic Elaeis guineensis (oil palm) single nucleotide polymorphism (SNP) in genomic region adjacent to shatterproof1 (SHELL) shell thickness gene
attttattgttaataaggcagggcrtgcaagtattgctcattgtgccttt

SEQ ID NO: 4987 - DNA, 50 bp, Artificial Sequence
  synthetic Elaeis guineensis (oil palm) single nucleotide polymorphism (SNP) in genomic region adjacent to shatterproof1 (SHELL) shell thickness gene
tccagaatcttcttgcaaatcgaasgttatattccaaatgggtgtgtgag

SEQ ID NO: 4988 - DNA, 50 bp, Artificial Sequence
  synthetic Elaeis guineensis (oil palm) single nucleotide polymorphism (SNP) in genomic region adjacent to shatterproof1 (SHELL) shell thickness gene
atatgtatatgcatggcaaatagcrttttcataattattctggaagtaag

SEQ ID NO: 4989 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttgtaatagattaaagatttttcwgtctcatctaatgctctagtagtgt

SEQ ID NO: 4990 - DNA, 50 bp, Artificial Sequence
  synthetic Elaeis guineensis (oil palm) single nucleotide polymorphism (SNP) in genomic region adjacent to shatterproof1 (SHELL) shell thickness gene
agaaatatttttctattttgacgtsgttcaagttctgtttattgagaaag

SEQ ID NO: 4991 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggtgggtggtgtttggggagttgcmaatgtagtgttagcaatacctccca

SEQ ID NO: 4992 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcattattatgaagagttaggcctkgtgcttgcagtgatgacaccagatc

SEQ ID NO: 4993 - DNA, 50 bp, Artificial Sequence
  synthetic Elaeis guineensis (oil palm) single nucleotide polymorphism (SNP) in genomic region adjacent to shatterproof1 (SHELL) shell thickness gene
aacttctctaacaatgagtgagttraactcttccaacatggagtttactc

SEQ ID NO: 4994 - DNA, 50 bp, Artificial Sequence
  synthetic Elaeis guineensis (oil palm) single nucleotide polymorphism (SNP) in genomic region adjacent to shatterproof1 (SHELL) shell thickness gene
tagataatgtttaaaggtagaaatrtgtaatttagttaaacttatatgta

SEQ ID NO: 4995 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatccaattctcatattcgttaccmtgcaatgcagatgctacatgaatta

SEQ ID NO: 4996 - DNA, 50 bp, Artificial Sequence
  synthetic Elaeis guineensis (oil palm) single nucleotide polymorphism (SNP) in genomic region adjacent to shatterproof1 (SHELL) shell thickness gene
gagatgtatgagggttctacttccragccatcctagtaatgggagaattc

SEQ ID NO: 4997 - DNA, 50 bp, Artificial Sequence
  synthetic Elaeis guineensis (oil palm) single nucleotide polymorphism (SNP) in genomic region adjacent to shatterproof1 (SHELL) shell thickness gene
atcagaggttgaaatggagttgtcyaagtcctaaagaatgttagatatat

SEQ ID NO: 4998 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatatcttgtatttcaagagagtarttcccatttttttggttttgctaat

SEQ ID NO: 4999 - DNA, 50 bp, Artificial Sequence
  synthetic Elaeis guineensis (oil palm) single nucleotide polymorphism (SNP) in genomic region adjacent to shatterproof1 (SHELL) shell thickness gene
agaggtctcacttgtgacttgtttyggtatttcaagttttctttctcagc

SEQ ID NO: 5000 - DNA, 50 bp, Artificial Sequence
  synthetic Elaeis guineensis (oil palm) single nucleotide polymorphism (SNP) in genomic region adjacent to shatterproof1 (SHELL) shell thickness gene
attttccatggtaaaacactttagrtaccatagatggaccacaaaaaatt

SEQ ID NO: 5001 - DNA, 50 bp, Artificial Sequence
  synthetic Elaeis guineensis (oil palm) single nucleotide polymorphism (SNP) in genomic region adjacent to shatterproof1 (SHELL) shell thickness gene
accacaaaaaattgttgatcatatrcacattgatttatgcccctagatct

SEQ ID NO: 5002 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctaagcagttgctaattttctttmatttgtcagtttatagaatttaaaa

SEQ ID NO: 5003 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctaagcagttgctaattttctttcmtttgtcagtttatagaatttaaaaa

SEQ ID NO: 5004 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtttatagaatttaaaaaaagtttwtgtccatagccttttaaaaatgtct

SEQ ID NO: 5005 - DNA, 50 bp, Artificial Sequence
  synthetic Elaeis guineensis (oil palm) single nucleotide polymorphism (SNP) in genomic region adjacent to shatterproof1 (SHELL) shell thickness gene
catggaagttgttttagttttcctrtcaatactgacttgatgttatttta

SEQ ID NO: 5006 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttcatgtttactgctctgatggtwtaagcattagtccgtttgagatcct

SEQ ID NO: 5007 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaccaagagatggatagattgacmtgcaactttttatagcgtttccatt

SEQ ID NO: 5008 - DNA, 50 bp, Artificial Sequence
  synthetic Elaeis guineensis (oil palm) single nucleotide polymorphism (SNP) in genomic region adjacent to shatterproof1 (SHELL) shell thickness gene
attagatgccctccgtagaataatkgaaaggttgagaaaataaaagtttc

SEQ ID NO: 5009 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgattttgaaattagatgccctccrtagaataattgaaaggttgagaaaa

SEQ ID NO: 5010 - DNA, 50 bp, Artificial Sequence
  synthetic Elaeis guineensis (oil palm) single nucleotide polymorphism (SNP) in genomic region adjacent to shatterproof1 (SHELL) shell thickness gene
attgattttgaaattagatgccctycgtagaataattgaaaggttgagaa

SEQ ID NO: 5011 - DNA, 50 bp, Artificial Sequence
  synthetic Elaeis guineensis (oil palm) single nucleotide polymorphism (SNP) in genomic region adjacent to shatterproof1 (SHELL) shell thickness gene
gacgaagtgtggttgttagactatygttgaagatggtttctgacttgaag

SEQ ID NO: 5012 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgcatttaatgttgaaatatgactrcttataaaatagttgttacttccaa

SEQ ID NO: 5013 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttctctgtgtttttatgaaaaacygtgatacatgttaacagatatgata

SEQ ID NO: 5014 - DNA, 50 bp, Artificial Sequence
  synthetic Elaeis guineensis (oil palm) single nucleotide polymorphism (SNP) in genomic region adjacent to shatterproof1 (SHELL) shell thickness gene
atgtttgagtgaaggtggatttgcygatcattgtttgagtgaagtttatg

SEQ ID NO: 5015 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttttctgtcaggtacggaaaacamctgttaattttttggagtgctattt

SEQ ID NO: 5016 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaaagcgctgctgtgcccttattayctggatgaccagaaccagctctgat

SEQ ID NO: 5017 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttaacgattttattgagtgagttcrtcgacattatcattgaaagtcatta

SEQ ID NO: 5018 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaggtgaagatttcggggatctascgttggaatttggaaactgcttccc

SEQ ID NO: 5019 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttgaagaatggatttttcatgttaygtgcttgtctacggataggtattag

SEQ ID NO: 5020 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcttcatcctttgaagaatggattkttcatgttatgtgcttgtctacgga

SEQ ID NO: 5021 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttacttactgatgttctaaggggargcaaaatattcataattcaagcaac

SEQ ID NO: 5022 - DNA, 50 bp, Artificial Sequence
  synthetic Elaeis guineensis (oil palm) single nucleotide polymorphism (SNP) in genomic region adjacent to shatterproof1 (SHELL) shell thickness gene
agtaatatgtgatgcaaaagctcaracatgatatgcaaccttggaaatca

SEQ ID NO: 5023 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaatacaaggttatcataatataamgtaatatgtgatgcaaaagctcaga

SEQ ID NO: 5024 - DNA, 50 bp, Artificial Sequence
  synthetic Elaeis guineensis (oil palm) single nucleotide polymorphism (SNP) in genomic region adjacent to shatterproof1 (SHELL) shell thickness gene
acaatttctaattgaataatgttgyacttcatctcttaccatatggaaaa

SEQ ID NO: 5025 - DNA, 50 bp, Artificial Sequence
  synthetic Elaeis guineensis (oil palm) single nucleotide polymorphism (SNP) in genomic region adjacent to shatterproof1 (SHELL) shell thickness gene
caatcatttgtaatattataaactracacttctttttgggtcctcttttc

SEQ ID NO: 5026 - DNA, 50 bp, Artificial Sequence
  synthetic Elaeis guineensis (oil palm) single nucleotide polymorphism (SNP) in genomic region adjacent to shatterproof1 (SHELL) shell thickness gene
aggcatagggcccatggcctcacckattatgagagacaaaaggctagcgc

SEQ ID NO: 5027 - DNA, 50 bp, Artificial Sequence
  synthetic Elaeis guineensis (oil palm) single nucleotide polymorphism (SNP) in genomic region adjacent to shatterproof1 (SHELL) shell thickness gene
agatttaatctagtatataactggycaaataatataacaggcatagggcc

SEQ ID NO: 5028 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttaggtagaaataatctagtacttrttttgcatgtcatgtagggattagg

SEQ ID NO: 5029 - DNA, 50 bp, Artificial Sequence
  synthetic Elaeis guineensis (oil palm) single nucleotide polymorphism (SNP) in genomic region adjacent to shatterproof1 (SHELL) shell thickness gene
attaggtagaaataatctagtactyattttgcatgtcatgtagggattag

SEQ ID NO: 5030 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcttatctgtggatggattaatggkacattcaaacaaccacttattgcca

SEQ ID NO: 5031 - DNA, 50 bp, Artificial Sequence
  synthetic Elaeis guineensis (oil palm) single nucleotide polymorphism (SNP) in genomic region adjacent to shatterproof1 (SHELL) shell thickness gene
accattttaagacggttgacagccmctaatcatggcttatctgtggatgg

SEQ ID NO: 5032 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttcctttccctcaccattttaagabggttgacagccactaatcatggctt

SEQ ID NO: 5033 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccggaattaggagtgcttggaagcmcctctcaatcggttccattgttcct

SEQ ID NO: 5034 - DNA, 50 bp, Artificial Sequence
  synthetic Elaeis guineensis (oil palm) single nucleotide polymorphism (SNP) in genomic region adjacent to shatterproof1 (SHELL) shell thickness gene
gatcgagtctttaccttagaaaacyggaattaggagtgcttggaagcccc

SEQ ID NO: 5035 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaatatcgagctctttaatccctawaatttagagataaggaaaaacacct

SEQ ID NO: 5036 - DNA, 50 bp, Artificial Sequence
  synthetic Elaeis guineensis (oil palm) single nucleotide polymorphism (SNP) in genomic region adjacent to shatterproof1 (SHELL) shell thickness gene
tggatgcccatctaatttatacttygtatatttccatttctggataaaga

SEQ ID NO: 5037 - DNA, 50 bp, Artificial Sequence
  synthetic Elaeis guineensis (oil palm) single nucleotide polymorphism (SNP) in genomic region adjacent to shatterproof1 (SHELL) shell thickness gene
gattttagatgtttttcctaactaytttagtttcatccctttctcttggg

SEQ ID NO: 5038 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatccgtatgttttcttcatgtgcycaaagtcatctagtttttctattat

SEQ ID NO: 5039 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttttaaacaattgtatttctatcygtatgttttcttcatgtgctcaaag

SEQ ID NO: 5040 - DNA, 50 bp, Artificial Sequence
  synthetic Elaeis guineensis (oil palm) single nucleotide polymorphism (SNP) in genomic region adjacent to shatterproof1 (SHELL) shell thickness gene
tagataatcgctttcatttcacgaygtatcatgccattttgtatcggtta

SEQ ID NO: 5041 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgtagataatcgctttcatttcacratgtatcatgccattttgtatcggt

SEQ ID NO: 5042 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttaaatatgtccctaaagtgattsgattttttcaaaaccaatgattggc

SEQ ID NO: 5043 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaacctgagagtccaacaacttgawtatatatgcacatactatatcatgt

SEQ ID NO: 5044 - DNA, 50 bp, Artificial Sequence
  synthetic Elaeis guineensis (oil palm) single nucleotide polymorphism (SNP) in genomic region adjacent to shatterproof1 (SHELL) shell thickness gene
attctaggatctgatttcacatcakattgaagtcgaatatagcgatatca

SEQ ID NO: 5045 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgtacaaataatacccgaaaacctracaattcgactcgattattttgtaa

SEQ ID NO: 5046 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttggactttgtggccttccacccgyagaatcgagaaatttgtttatggat

SEQ ID NO: 5047 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatgaaaatgttcacctcttctacwttttgttgttctgaaaaaacataga

SEQ ID NO: 5048 - DNA, 50 bp, Artificial Sequence
  synthetic Elaeis guineensis (oil palm) single nucleotide polymorphism (SNP) in genomic region adjacent to shatterproof1 (SHELL) shell thickness gene
atgctaagccccatgaaacgagaakaatgaaaatgttcacctcttctact

SEQ ID NO: 5049 - DNA, 50 bp, Artificial Sequence
  synthetic Elaeis guineensis (oil palm) single nucleotide polymorphism (SNP) in genomic region adjacent to shatterproof1 (SHELL) shell thickness gene
aattacatgctaagccccatgaaaygagaataatgaaaatgttcacctct

SEQ ID NO: 5050 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctaaagtctaaaacattctaagacygccttttaactaaaatgattatact

SEQ ID NO: 5051 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagcttacacctgggtttaaataakaggcagcatgtttttatactcacac

SEQ ID NO: 5052 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcttcattctctctttgataagatrattataagcttacacctgggtttaa

SEQ ID NO: 5053 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatggttcccttttgataaacaggscaggtatgtggggtcaggtagtcat

SEQ ID NO: 5054 - DNA, 50 bp, Artificial Sequence
  synthetic Elaeis guineensis (oil palm) single nucleotide polymorphism (SNP) in genomic region adjacent to shatterproof1 (SHELL) shell thickness gene
gttttctgcagggaaactggagttraatataattttatgttggcagggtc

SEQ ID NO: 5055 - DNA, 50 bp, Artificial Sequence
  synthetic Elaeis guineensis (oil palm) single nucleotide polymorphism (SNP) in genomic region adjacent to shatterproof1 (SHELL) shell thickness gene
ataaatagcatttatgttgagggtmatgttttctgcagggaaactggagt

SEQ ID NO: 5056 - DNA, 50 bp, Artificial Sequence
  synthetic Elaeis guineensis (oil palm) single nucleotide polymorphism (SNP) in genomic region adjacent to shatterproof1 (SHELL) shell thickness gene
atgatggacttattaacgtgaatgytggtgtctttgggaagcaggaagta

SEQ ID NO: 5057 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccatcctccacaaggggtggctgawtgcaagctctggctgtgctattaga

SEQ ID NO: 5058 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggtggctttttcttcttccgtctamccccatcctccacaaggggtggctg

SEQ ID NO: 5059 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggaagctaccattacggattgctayagtatttaagatacaacatcatcct

SEQ ID NO: 5060 - DNA, 50 bp, Artificial Sequence
  synthetic Elaeis guineensis (oil palm) single nucleotide polymorphism (SNP) in genomic region adjacent to shatterproof1 (SHELL) shell thickness gene
caagatcttaatgccacgcaccgawtgaaaggaagctaccattacggatt

SEQ ID NO: 5061 - DNA, 50 bp, Artificial Sequence
  synthetic Elaeis guineensis (oil palm) single nucleotide polymorphism (SNP) in genomic region adjacent to shatterproof1 (SHELL) shell thickness gene
cagcaagatcttaatgccacgcacygaatgaaaggaagctaccattacgg

SEQ ID NO: 5062 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatgtcagcaagatcttaatgccaygcaccgaatgaaaggaagctaccat

SEQ ID NO: 5063 - DNA, 50 bp, Artificial Sequence
  synthetic Elaeis guineensis (oil palm) single nucleotide polymorphism (SNP) in genomic region adjacent to shatterproof1 (SHELL) shell thickness gene
catatggtatcgacccaacttttcrgcctccctgtcagtattactaagaa

SEQ ID NO: 5064 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgaaaaaggcgttggtgcattttcrtaatgtgtatttttttgtaaggcat

SEQ ID NO: 5065 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaaagatggggcatgagggggagtrgctgagagcctaataagctttggaa

SEQ ID NO: 5066 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttgactagaataatttaatttcctwtaagatcattctatgttgaaacctt

SEQ ID NO: 5067 - DNA, 50 bp, Artificial Sequence
  synthetic Elaeis guineensis (oil palm) single nucleotide polymorphism (SNP) in genomic region adjacent to shatterproof1 (SHELL) shell thickness gene
tagtatatggtgcaaggtcctcaaktacaaaaatatagtttgtgattcag

SEQ ID NO: 5068 - DNA, 50 bp, Artificial Sequence
  synthetic Elaeis guineensis (oil palm) single nucleotide polymorphism (SNP) in genomic region adjacent to shatterproof1 (SHELL) shell thickness gene
attccgtagctttttaacagggccratgttactaaatttttgttagttgc

SEQ ID NO: 5069 - DNA, 50 bp, Artificial Sequence
  synthetic Elaeis guineensis (oil palm) single nucleotide polymorphism (SNP) in genomic region adjacent to shatterproof1 (SHELL) shell thickness gene
tattgaatgagctctcagttttttkggcattcttaaatatggaacgtatg

SEQ ID NO: 5070 - DNA, 50 bp, Artificial Sequence
  synthetic Elaeis guineensis (oil palm) single nucleotide polymorphism (SNP) in genomic region adjacent to shatterproof1 (SHELL) shell thickness gene
gacaagtattgtaatgttttagtgygaaactggcacaagtatgggcattg

SEQ ID NO: 5071 - DNA, 50 bp, Artificial Sequence
  synthetic Elaeis guineensis (oil palm) single nucleotide polymorphism (SNP) in genomic region adjacent to shatterproof1 (SHELL) shell thickness gene
gatctagggggtgtatcaaatatckgtacactgaactcaccgtccaaccg

SEQ ID NO: 5072 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaggtagtcaaggccaacatccaakcctgtgattccaatgaaaagattga

SEQ ID NO: 5073 - DNA, 50 bp, Artificial Sequence
  synthetic Elaeis guineensis (oil palm) single nucleotide polymorphism (SNP) in genomic region adjacent to shatterproof1 (SHELL) shell thickness gene
cttttgtagttggaggtagtcaagsccaacatccaagcctgtgattccaa

SEQ ID NO: 5074 - DNA, 50 bp, Artificial Sequence
  synthetic Elaeis guineensis (oil palm) single nucleotide polymorphism (SNP) in genomic region adjacent to shatterproof1 (SHELL) shell thickness gene
cctaggttatgataaatttcctttycctcttgttcaatccaatcttatca

SEQ ID NO: 5075 - DNA, 50 bp, Artificial Sequence
  synthetic Elaeis guineensis (oil palm) single nucleotide polymorphism (SNP) in genomic region adjacent to shatterproof1 (SHELL) shell thickness gene
acttcatgttaacttctctttatgygtaaaaatttgtttcttctagttac

SEQ ID NO: 5076 - DNA, 50 bp, Artificial Sequence
  synthetic Elaeis guineensis (oil palm) single nucleotide polymorphism (SNP) in genomic region adjacent to shatterproof1 (SHELL) shell thickness gene
cccccacctcatatatatatatatrtatgtatgtatgtatgtatgtatgt

SEQ ID NO: 5077 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttgagtggagatctactcgagtgwagcccaatcccccccacctcatata

SEQ ID NO: 5078 - DNA, 50 bp, Artificial Sequence
  synthetic Elaeis guineensis (oil palm) single nucleotide polymorphism (SNP) in genomic region adjacent to shatterproof1 (SHELL) shell thickness gene
tggtgaaccgaactggctagaaatygggaagttcgattaagcatcaagtg

SEQ ID NO: 5079 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaccagaattgataaaccacaaaraagccataagcttcgaaactgaata

SEQ ID NO: 5080 - DNA, 50 bp, Artificial Sequence
  synthetic Elaeis guineensis (oil palm) single nucleotide polymorphism (SNP) in genomic region adjacent to shatterproof1 (SHELL) shell thickness gene
ataacttccacagattttattgtcstgatgagactgacttgatcagaaga

SEQ ID NO: 5081 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctaatgttgttcccacttcccactytctttgtgaaggcaactttatcacc

SEQ ID NO: 5082 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccagttctgcaggtttgaatttctkggcaaataaatatctgagaacacct

SEQ ID NO: 5083 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttgctcctgctgttatcaatgcatkctctcacatgccgttcaacattgca

SEQ ID NO: 5084 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttctaattataccattttgtatccyctattttttgagtcttcaaaaaact

SEQ ID NO: 5085 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgattctgctgatgattaagtttgytctcatcgtaagagtcagaatatca

SEQ ID NO: 5086 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgttgctgtccattttatctgtggktcttcacttgcatgattatctgatt

SEQ ID NO: 5087 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatattgtggatcgtttctatttcyaacagtaaacatcaccgtgatccaa

SEQ ID NO: 5088 - DNA, 50 bp, Artificial Sequence
  synthetic Elaeis guineensis (oil palm) single nucleotide polymorphism (SNP) in genomic region adjacent to shatterproof1 (SHELL) shell thickness gene
atggtttcttgggtaaaatgcagtstcacatttatattgtggatcgtttc

SEQ ID NO: 5089 - DNA, 50 bp, Artificial Sequence
  synthetic Elaeis guineensis (oil palm) single nucleotide polymorphism (SNP) in genomic region adjacent to shatterproof1 (SHELL) shell thickness gene
caggtttctctatatcctttctaasaacttgggtttttcttggtcctcgt

SEQ ID NO: 5090 - DNA, 50 bp, Artificial Sequence
  synthetic Elaeis guineensis (oil palm) single nucleotide polymorphism (SNP) in genomic region adjacent to shatterproof1 (SHELL) shell thickness gene
cgaggtgggcttataattgtaacaygagtttatctttgtgattcaggttt

SEQ ID NO: 5091 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggatcattttgtggttctttctttrctagaactcattcaatttttatgag

SEQ ID NO: 5092 - DNA, 50 bp, Artificial Sequence
  synthetic Elaeis guineensis (oil palm) single nucleotide polymorphism (SNP) in genomic region adjacent to shatterproof1 (SHELL) shell thickness gene
aacctcgatggttttggtggaaccrtggaagctttctcattcttacggat

SEQ ID NO: 5093 - DNA, 50 bp, Artificial Sequence
  synthetic Elaeis guineensis (oil palm) single nucleotide polymorphism (SNP) in genomic region adjacent to shatterproof1 (SHELL) shell thickness gene
gatttcatcatttccgaacaaagcygaagatctttaactgtgcattagga

SEQ ID NO: 5094 - DNA, 50 bp, Artificial Sequence
  synthetic Elaeis guineensis (oil palm) single nucleotide polymorphism (SNP) in genomic region adjacent to shatterproof1 (SHELL) shell thickness gene
attcacctttggtccctttgaagtkgatatctaattctcaaaattatcta

SEQ ID NO: 5095 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctcagtttatagcatgatctccatkcgatcaccatgtagggaatgaaaag

SEQ ID NO: 5096 - DNA, 50 bp, Artificial Sequence
  synthetic Elaeis guineensis (oil palm) single nucleotide polymorphism (SNP) in genomic region adjacent to shatterproof1 (SHELL) shell thickness gene
tataaatctctaaaaatttattatrtaagcaacagatctgcttattcaaa

SEQ ID NO: 5097 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttataaatctctaaaaatttattaygtaagcaacagatctgcttattcaa

SEQ ID NO: 5098 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcctatttagtgattcttctctccycaaaatcttcaatcataacatttat

SEQ ID NO: 5099 - DNA, 50 bp, Artificial Sequence
  synthetic Elaeis guineensis (oil palm) single nucleotide polymorphism (SNP) in genomic region adjacent to shatterproof1 (SHELL) shell thickness gene
cttttttcttgattatttatctttktttttttaattatttaacttctctt

SEQ ID NO: 5100 - DNA, 50 bp, Artificial Sequence
  synthetic Elaeis guineensis (oil palm) single nucleotide polymorphism (SNP) in genomic region adjacent to shatterproof1 (SHELL) shell thickness gene
acctcgagtgcctcactcacctcamtgttggtgccttttttgcaccttga

SEQ ID NO: 5101 - DNA, 50 bp, Artificial Sequence
  synthetic Elaeis guineensis (oil palm) single nucleotide polymorphism (SNP) in genomic region adjacent to shatterproof1 (SHELL) shell thickness gene
cctaatttatgataatccagctgcmagacacaagtgaagcgcacctcgag

SEQ ID NO: 5102 - DNA, 50 bp, Artificial Sequence
  synthetic Elaeis guineensis (oil palm) single nucleotide polymorphism (SNP) in genomic region adjacent to shatterproof1 (SHELL) shell thickness gene
acccatagagttttggctgttttgycgttcttttctcatcctaatttatg

SEQ ID NO: 5103 - DNA, 50 bp, Artificial Sequence
  synthetic Elaeis guineensis (oil palm) single nucleotide polymorphism (SNP) in genomic region adjacent to shatterproof1 (SHELL) shell thickness gene
agggttccgggagtccgatggaggrctttgacgattggggtctaagcgcc

SEQ ID NO: 5104 - DNA, 50 bp, Artificial Sequence
  synthetic Elaeis guineensis (oil palm) single nucleotide polymorphism (SNP) in genomic region adjacent to shatterproof1 (SHELL) shell thickness gene
tggaatgaaaatagggtcgaaattytaaaactcatttacacagcgagaga

SEQ ID NO: 5105 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggtatattgatcttttggtaattcyttttatcaaaaaattatgtcaattg

SEQ ID NO: 5106 - DNA, 50 bp, Artificial Sequence
  synthetic Elaeis guineensis (oil palm) single nucleotide polymorphism (SNP) in genomic region adjacent to shatterproof1 (SHELL) shell thickness gene
atccttataaactagtcgtttatgrtcattggtaaaggtatattgatctt

SEQ ID NO: 5107 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtgctatcataacaagatctatttrtactaataactagaagcgaaaatag

SEQ ID NO: 5108 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcaccatccaaaattaaatttaatrattgtttcattaaagaaacaccagc

SEQ ID NO: 5109 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaaaatatctctaaatttttattragaattgaattacttgttattcgaa

SEQ ID NO: 5110 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcagtattttatttttaaatactamatcattacttattattataatcaaa

SEQ ID NO: 5111 - DNA, 50 bp, Artificial Sequence
  synthetic Elaeis guineensis (oil palm) single nucleotide polymorphism (SNP) in genomic region adjacent to shatterproof1 (SHELL) shell thickness gene
tacccatgaggtggtcaattcatcrtgcaacctcttgagatatgatcagt

SEQ ID NO: 5112 - DNA, 50 bp, Artificial Sequence
  synthetic Elaeis guineensis (oil palm) single nucleotide polymorphism (SNP) in genomic region adjacent to shatterproof1 (SHELL) shell thickness gene
tggaaccttgcaattgaagatggcrgtacatgcaagtgagttgcttgcaa

SEQ ID NO: 5113 - DNA, 50 bp, Artificial Sequence
  synthetic Elaeis guineensis (oil palm) single nucleotide polymorphism (SNP) in genomic region adjacent to shatterproof1 (SHELL) shell thickness gene
catgatataatatctactatagcarttgttgctgctaaatattaaaaata

SEQ ID NO: 5114 - DNA, 50 bp, Artificial Sequence
  synthetic Elaeis guineensis (oil palm) single nucleotide polymorphism (SNP) in genomic region adjacent to shatterproof1 (SHELL) shell thickness gene
gagagccagaactgagggaagtgtmagaagagaggcaaaggtaacccaac

SEQ ID NO: 5115 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatccctacatgcttggagagataygagataaaatctgaacaaattatac

SEQ ID NO: 5116 - DNA, 50 bp, Artificial Sequence
  synthetic Elaeis guineensis (oil palm) single nucleotide polymorphism (SNP) in genomic region adjacent to shatterproof1 (SHELL) shell thickness gene
aacataaaagaaaacatccacaggratcttaaatcttcggacaagcaata

SEQ ID NO: 5117 - DNA, 50 bp, Artificial Sequence
  synthetic Elaeis guineensis (oil palm) single nucleotide polymorphism (SNP) in genomic region adjacent to shatterproof1 (SHELL) shell thickness gene
agaattaaaaaatatatatatagtkttaacagtgctaaaagcctaccttg

SEQ ID NO: 5118 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaccatatcaaaaagaattaaaawatatatatatagttttaacagtgct

SEQ ID NO: 5119 - DNA, 50 bp, Artificial Sequence
  synthetic Elaeis guineensis (oil palm) single nucleotide polymorphism (SNP) in genomic region adjacent to shatterproof1 (SHELL) shell thickness gene
caacaaaagaaagaaaagtagcaasccacatgccacagaaatagggaatt

SEQ ID NO: 5120 - DNA, 50 bp, Artificial Sequence
  synthetic Elaeis guineensis (oil palm) single nucleotide polymorphism (SNP) in genomic region adjacent to shatterproof1 (SHELL) shell thickness gene
cccattcgtactgtctgcatctctrtttagccagaacgagaataccttgt

SEQ ID NO: 5121 - DNA, 50 bp, Artificial Sequence
  synthetic Elaeis guineensis (oil palm) single nucleotide polymorphism (SNP) in genomic region adjacent to shatterproof1 (SHELL) shell thickness gene
tggaacataggtatgttctcccttraaatgtcttggatcaacacctccaa

SEQ ID NO: 5122 - DNA, 50 bp, Artificial Sequence
  synthetic Elaeis guineensis (oil palm) single nucleotide polymorphism (SNP) in genomic region adjacent to shatterproof1 (SHELL) shell thickness gene
tacaagcttgaaggaacatacagtwggccctgcaagcaaggaagttccag

SEQ ID NO: 5123 - DNA, 50 bp, Artificial Sequence
  synthetic Elaeis guineensis (oil palm) single nucleotide polymorphism (SNP) in genomic region adjacent to shatterproof1 (SHELL) shell thickness gene
cctagttggcatgattatccatcayagctttatcttaaagcaagagaaaa

SEQ ID NO: 5124 - DNA, 50 bp, Artificial Sequence
  synthetic Elaeis guineensis (oil palm) single nucleotide polymorphism (SNP) in genomic region adjacent to shatterproof1 (SHELL) shell thickness gene
acaaagacagcatctttgcaaagamaatacctagttggcatgattatcca

SEQ ID NO: 5125 - DNA, 50 bp, Artificial Sequence
  synthetic Elaeis guineensis (oil palm) single nucleotide polymorphism (SNP) in genomic region adjacent to shatterproof1 (SHELL) shell thickness gene
aggaaaaagatatagtgagtttggmatactcaaacatgaagtaaagagga

SEQ ID NO: 5126 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgctgaagtgggcctcagcaccagrccaagtgcccaagcagacaggccct

SEQ ID NO: 5127 - DNA, 50 bp, Artificial Sequence
  synthetic Elaeis guineensis (oil palm) single nucleotide polymorphism (SNP) in genomic region adjacent to shatterproof1 (SHELL) shell thickness gene
ataaaaatttaagaaaattgaaatycataactccgtaattataccaccgt

SEQ ID NO: 5128 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatttgggcgactatggtctgaaaygattaaaaggatcaaatataaattt

SEQ ID NO: 5129 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtatcaactctccatactgtttaaygacctctttacattccatgctcaca

SEQ ID NO: 5130 - DNA, 50 bp, Artificial Sequence
  synthetic Elaeis guineensis (oil palm) single nucleotide polymorphism (SNP) in genomic region adjacent to shatterproof1 (SHELL) shell thickness gene
attatctccttacctcttctggagwtaggctgaaagttttattggctatt

SEQ ID NO: 5131 - DNA, 50 bp, Artificial Sequence
  synthetic Elaeis guineensis (oil palm) single nucleotide polymorphism (SNP) in genomic region adjacent to shatterproof1 (SHELL) shell thickness gene
agtgattaagcctaatatattatckccttacctcttctggagttaggctg

SEQ ID NO: 5132 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttcattgtgatgtaaaaagggcgtytgagcccaagcagggctagagtggg

SEQ ID NO: 5133 - DNA, 50 bp, Artificial Sequence
  synthetic Elaeis guineensis (oil palm) single nucleotide polymorphism (SNP) in genomic region adjacent to shatterproof1 (SHELL) shell thickness gene
taagcttcccggtcttcattgtgaygtaaaaagggcgtctgagcccaagc

SEQ ID NO: 5134 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagaaaataagtaggtagcaagtcrattgatagagagaggaaggacactt

SEQ ID NO: 5135 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaagtattaatcctgcaatgcggamgagctagaaatatctcaaagtttat

SEQ ID NO: 5136 - DNA, 50 bp, Artificial Sequence
  synthetic Elaeis guineensis (oil palm) single nucleotide polymorphism (SNP) in genomic region adjacent to shatterproof1 (SHELL) shell thickness gene
accccgcccaaatacccacacgtcyaccggcacttctcccctaccttatc

SEQ ID NO: 5137 - DNA, 50 bp, Artificial Sequence
  synthetic Elaeis guineensis (oil palm) single nucleotide polymorphism (SNP) in genomic region adjacent to shatterproof1 (SHELL) shell thickness gene
cttcgacacgtgtcgagtacgtaasctcgaagtctcctatttcctacgca

SEQ ID NO: 5138 - DNA, 50 bp, Artificial Sequence
  synthetic Elaeis guineensis (oil palm) single nucleotide polymorphism (SNP) in genomic region adjacent to shatterproof1 (SHELL) shell thickness gene
gacatggtcctggaatataggccakggcgcatgaatcaagtggctgatgc

SEQ ID NO: 5139 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttctggcagagtttgacatggtcytggaatataggccagggcgcatgaa

SEQ ID NO: 5140 - DNA, 50 bp, Artificial Sequence
  synthetic Elaeis guineensis (oil palm) single nucleotide polymorphism (SNP) in genomic region adjacent to shatterproof1 (SHELL) shell thickness gene
acacagaagaagctatctcccaaayaagcccgttggcaagattttctggc

SEQ ID NO: 5141 - DNA, 50 bp, Artificial Sequence
  synthetic Elaeis guineensis (oil palm) single nucleotide polymorphism (SNP) in genomic region adjacent to shatterproof1 (SHELL) shell thickness gene
gctgcggttgccagatcatacactrccattcgaagtccacactgatgctt

SEQ ID NO: 5142 - DNA, 50 bp, Artificial Sequence
  synthetic Elaeis guineensis (oil palm) single nucleotide polymorphism (SNP) in genomic region adjacent to shatterproof1 (SHELL) shell thickness gene
cacggtttattacgggttattcccrtcgtgctgcacccttgacggagtta

SEQ ID NO: 5143 - DNA, 50 bp, Artificial Sequence
  synthetic Elaeis guineensis (oil palm) single nucleotide polymorphism (SNP) in genomic region adjacent to shatterproof1 (SHELL) shell thickness gene
aacattttacttttattcttttaaygatgctgatttttcctatgatgtta

SEQ ID NO: 5144 - DNA, 50 bp, Artificial Sequence
  synthetic Elaeis guineensis (oil palm) single nucleotide polymorphism (SNP) in genomic region adjacent to shatterproof1 (SHELL) shell thickness gene
cttccttgtttggatcatccttttyggatgttgtgatctccttcttcatc

SEQ ID NO: 5145 - DNA, 50 bp, Artificial Sequence
  synthetic Elaeis guineensis (oil palm) single nucleotide polymorphism (SNP) in genomic region adjacent to shatterproof1 (SHELL) shell thickness gene
gggcctcgtgcggacaatctcgatrccatccgaagtggggtatgtgcgag

SEQ ID NO: 5146 - DNA, 50 bp, Artificial Sequence
  synthetic Elaeis guineensis (oil palm) single nucleotide polymorphism (SNP) in genomic region adjacent to shatterproof1 (SHELL) shell thickness gene
atcttatcttcatcttagcccttckgggcttaccaatccggagatcgggt

SEQ ID NO: 5147 - DNA, 50 bp, Artificial Sequence
  synthetic Elaeis guineensis (oil palm) single nucleotide polymorphism (SNP) in genomic region adjacent to shatterproof1 (SHELL) shell thickness gene
atcggatttttggtcttctcaggaytgatccgaaggtcgatgtttaggtc

SEQ ID NO: 5148 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttatgagatttaatccagagatcrgatttttggtcttctcaggattgat

SEQ ID NO: 5149 - DNA, 50 bp, Artificial Sequence
  synthetic Elaeis guineensis (oil palm) single nucleotide polymorphism (SNP) in genomic region adjacent to shatterproof1 (SHELL) shell thickness gene
tccaatccggagatcaatttttctrcataaaattttagtgaagtccactc

SEQ ID NO: 5150 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatcttttcgagacttgcgaagtcyaatccggagatcaatttttctgcat

SEQ ID NO: 5151 - DNA, 50 bp, Artificial Sequence
  synthetic Elaeis guineensis (oil palm) single nucleotide polymorphism (SNP) in genomic region adjacent to shatterproof1 (SHELL) shell thickness gene
agggcatttcacatgaaattttaarctagaatttatcttttcgagacttg

SEQ ID NO: 5152 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccaagaaaaaagttttcaacttgtycgatgtggcaaatctgtaccatttg

SEQ ID NO: 5153 - DNA, 50 bp, Artificial Sequence
  synthetic Elaeis guineensis (oil palm) single nucleotide polymorphism (SNP) in genomic region adjacent to shatterproof1 (SHELL) shell thickness gene
gatcggctttatgatgacatcagcyttccgataaggtcggctttatgatg

SEQ ID NO: 5154 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggccttatgatgatctcagagtttygataagatcgactttatgataatct

SEQ ID NO: 5155 - DNA, 50 bp, Artificial Sequence
  synthetic Elaeis guineensis (oil palm) single nucleotide polymorphism (SNP) in genomic region adjacent to shatterproof1 (SHELL) shell thickness gene
ataaatcttttttatgtcatattamatttatatgaacaaattgaacaaac

SEQ ID NO: 5156 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctcatctgggatgtctggacctctyttcgtcaaactgttgcagttagagt

SEQ ID NO: 5157 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtttggattcagagaggtgctaggyagctcgaagcccatcctctcatctg

SEQ ID NO: 5158 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgatgggagacttatagtggctggkggctcccacccctttgagccttctg

SEQ ID NO: 5159 - DNA, 50 bp, Artificial Sequence
  synthetic Elaeis guineensis (oil palm) single nucleotide polymorphism (SNP) in genomic region adjacent to shatterproof1 (SHELL) shell thickness gene
agggacaggagaggtggagcaggcyttgttatccatggccctgatgggag

SEQ ID NO: 5160 - DNA, 50 bp, Artificial Sequence
  synthetic Elaeis guineensis (oil palm) single nucleotide polymorphism (SNP) in genomic region adjacent to shatterproof1 (SHELL) shell thickness gene
aactttgatggctgtgtcagggacrggagaggtggagcaggctttgttat

SEQ ID NO: 5161 - DNA, 50 bp, Artificial Sequence
  synthetic Elaeis guineensis (oil palm) single nucleotide polymorphism (SNP) in genomic region adjacent to shatterproof1 (SHELL) shell thickness gene
cgtgatgatctcagatcagagggayacttatatccatatctttttggaat

SEQ ID NO: 5162 - DNA, 50 bp, Artificial Sequence
  synthetic Elaeis guineensis (oil palm) single nucleotide polymorphism (SNP) in genomic region adjacent to shatterproof1 (SHELL) shell thickness gene
acaactaatacctatccaaagtggstgacaaaaagaatgttagcttctga

SEQ ID NO: 5163 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaataggcaccttcacaagagccrgtgggtaggtagagtaggataagaa

SEQ ID NO: 5164 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctgaaagtcctcgttggttactcrcagccgcacaagcatccaatctcta

SEQ ID NO: 5165 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaacaaggagatggtacgtcgagaygatcgccttgagggcgttcaatccg

SEQ ID NO: 5166 - DNA, 50 bp, Artificial Sequence
  synthetic Elaeis guineensis (oil palm) single nucleotide polymorphism (SNP) in genomic region adjacent to shatterproof1 (SHELL) shell thickness gene
atctccgcgcatctctccgattccrtttttggtcgggaaccgaacaagga

SEQ ID NO: 5167 - DNA, 50 bp, Artificial Sequence
  synthetic Elaeis guineensis (oil palm) single nucleotide polymorphism (SNP) in genomic region adjacent to shatterproof1 (SHELL) shell thickness gene
gatctccgcgcatctctccgattcyatttttggtcgggaaccgaacaagg

SEQ ID NO: 5168 - DNA, 50 bp, Artificial Sequence
  synthetic Elaeis guineensis (oil palm) single nucleotide polymorphism (SNP) in genomic region adjacent to shatterproof1 (SHELL) shell thickness gene
tccctcgactcgtcgctttgagcgragatttggaagcatcgtcgggcgag

SEQ ID NO: 5169 - DNA, 50 bp, Artificial Sequence
  synthetic Elaeis guineensis (oil palm) single nucleotide polymorphism (SNP) in genomic region adjacent to shatterproof1 (SHELL) shell thickness gene
tccagcttgtcgatcgtcagagaayccctcgactcgtcgctttgagcgaa

SEQ ID NO: 5170 - DNA, 50 bp, Artificial Sequence
  synthetic Elaeis guineensis (oil palm) single nucleotide polymorphism (SNP) in genomic region adjacent to shatterproof1 (SHELL) shell thickness gene
cgagcctcgttcttcctcctcccgytggtccagcttgtcgatcgtcagag

SEQ ID NO: 5171 - DNA, 50 bp, Artificial Sequence
  synthetic Elaeis guineensis (oil palm) single nucleotide polymorphism (SNP) in genomic region adjacent to shatterproof1 (SHELL) shell thickness gene
gggatcgcctcgagctactcggccrgcgagcctcgttcttcctcctcccg

SEQ ID NO: 5172 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctcctatcgggatcgcctcgagctrctcggccagcgagcctcgttcttcc

SEQ ID NO: 5173 - DNA, 50 bp, Artificial Sequence
  synthetic Elaeis guineensis (oil palm) single nucleotide polymorphism (SNP) in genomic region adjacent to shatterproof1 (SHELL) shell thickness gene
caaatatgtcggcattggccgtcarcagctccgtcagacggcgtcgttcg

SEQ ID NO: 5174 - DNA, 50 bp, Artificial Sequence
  synthetic Elaeis guineensis (oil palm) single nucleotide polymorphism (SNP) in genomic region adjacent to shatterproof1 (SHELL) shell thickness gene
gatgcccgacatatctgctgtcgaycaagcaaatatgtcggcattggccg

SEQ ID NO: 5175 - DNA, 50 bp, Artificial Sequence
  synthetic Elaeis guineensis (oil palm) single nucleotide polymorphism (SNP) in genomic region adjacent to shatterproof1 (SHELL) shell thickness gene
cggggatgcccgacatatctgctgycgatcaagcaaatatgtcggcattg

SEQ ID NO: 5176 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgagtcggtgggttattatttctgsggggatgcccgacatatctgctgtc

SEQ ID NO: 5177 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggagcgaaggacctcttcttctgcytcaccggtctcatcgtcgggtcgat

SEQ ID NO: 5178 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctgcctttctggagcgaaggacctyttcttctgcttcaccggtctcatcg

SEQ ID NO: 5179 - DNA, 50 bp, Artificial Sequence
  synthetic Elaeis guineensis (oil palm) single nucleotide polymorphism (SNP) in genomic region adjacent to shatterproof1 (SHELL) shell thickness gene
cttttttgaccatgacaacattggsgagccaatcgggatacgtggattct

SEQ ID NO: 5180 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaagtggaggatctgcatcgactayaccgacctcaaccgagcctgcccaa

SEQ ID NO: 5181 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctgcatcgactacaccgacctcaaycgagcctgcccaaaagatagcttcc

SEQ ID NO: 5182 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtcgatgcagatcctccacttcccrttggcttttttgaccatgacaacat

SEQ ID NO: 5183 - DNA, 50 bp, Artificial Sequence
  synthetic Elaeis guineensis (oil palm) single nucleotide polymorphism (SNP) in genomic region adjacent to shatterproof1 (SHELL) shell thickness gene
catccaccagctggtcgatcttggraagcgggaagctatcttttgggcag

SEQ ID NO: 5184 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcatccaccagctggtcgatcttgraaagcgggaagctatcttttgggca

SEQ ID NO: 5185 - DNA, 50 bp, Artificial Sequence
  synthetic Elaeis guineensis (oil palm) single nucleotide polymorphism (SNP) in genomic region adjacent to shatterproof1 (SHELL) shell thickness gene
atgaagctgagcagtcgaaatccgracgtcgcatccaccagctggtcgat

SEQ ID NO: 5186 - DNA, 50 bp, Artificial Sequence
  synthetic Elaeis guineensis (oil palm) single nucleotide polymorphism (SNP) in genomic region adjacent to shatterproof1 (SHELL) shell thickness gene
agacgaggagcacaccgcgttcgtractcccaagggcctctactgttatc

SEQ ID NO: 5187 - DNA, 50 bp, Artificial Sequence
  synthetic Elaeis guineensis (oil palm) single nucleotide polymorphism (SNP) in genomic region adjacent to shatterproof1 (SHELL) shell thickness gene
gctcctcgtcttcaggcaccatccrgatctgattgtacccgacgaaggcg

SEQ ID NO: 5188 - DNA, 50 bp, Artificial Sequence
  synthetic Elaeis guineensis (oil palm) single nucleotide polymorphism (SNP) in genomic region adjacent to shatterproof1 (SHELL) shell thickness gene
caccgcgttcgtgactcccaagggyctctactgttatcgggtgatgccct

SEQ ID NO: 5189 - DNA, 50 bp, Artificial Sequence
  synthetic Elaeis guineensis (oil palm) single nucleotide polymorphism (SNP) in genomic region adjacent to shatterproof1 (SHELL) shell thickness gene
aggtggcaccggcgttcttcagtcygaagggcatcacccgataacagtag

SEQ ID NO: 5190 - DNA, 50 bp, Artificial Sequence
  synthetic Elaeis guineensis (oil palm) single nucleotide polymorphism (SNP) in genomic region adjacent to shatterproof1 (SHELL) shell thickness gene
attgacaagtcgctggtaggtggcrccggcgttcttcagtctgaagggca

SEQ ID NO: 5191 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctggtctttgaagaccttattgacragtcgctggtaggtggcaccggcgt

SEQ ID NO: 5192 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatgaagctcaacccgaccaagtgygcttttggggtgacctcagggaagt

SEQ ID NO: 5193 - DNA, 50 bp, Artificial Sequence
  synthetic Elaeis guineensis (oil palm) single nucleotide polymorphism (SNP) in genomic region adjacent to shatterproof1 (SHELL) shell thickness gene
cattcggtgtcgtcgaagggtgcgraaggtctcctcgagatcctaaacat

SEQ ID NO: 5194 - DNA, 50 bp, Artificial Sequence
  synthetic Elaeis guineensis (oil palm) single nucleotide polymorphism (SNP) in genomic region adjacent to shatterproof1 (SHELL) shell thickness gene
cttccctgaggtcaccccaaaagcrcacttggtcgggttgagcttcattc

SEQ ID NO: 5195 - DNA, 50 bp, Artificial Sequence
  synthetic Elaeis guineensis (oil palm) single nucleotide polymorphism (SNP) in genomic region adjacent to shatterproof1 (SHELL) shell thickness gene
tggcctcaatccctctctgagagaygaggaatccgaggaacttccctgag

SEQ ID NO: 5196 - DNA, 50 bp, Artificial Sequence
  synthetic Elaeis guineensis (oil palm) single nucleotide polymorphism (SNP) in genomic region adjacent to shatterproof1 (SHELL) shell thickness gene
attggcctcaatccctctctgagaratgaggaatccgaggaacttccctg

SEQ ID NO: 5197 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaggattgcctttattttctcaggrttggcctcaatccctctctgagaga

SEQ ID NO: 5198 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcgactaagagcgacaattctttcrttcagctgttggacctccttcttgg

SEQ ID NO: 5199 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatcgactaagagcgacaattcttycgttcagctgttggacctccttctt

SEQ ID NO: 5200 - DNA, 50 bp, Artificial Sequence
  synthetic Elaeis guineensis (oil palm) single nucleotide polymorphism (SNP) in genomic region adjacent to shatterproof1 (SHELL) shell thickness gene
agagatgaatcgactaagagcgacrattctttcgttcagctgttggacct

SEQ ID NO: 5201 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtggcgcagagttttgaagaacggkaggcacctttcagctgatcgagaga

SEQ ID NO: 5202 - DNA, 50 bp, Artificial Sequence
  synthetic Elaeis guineensis (oil palm) single nucleotide polymorphism (SNP) in genomic region adjacent to shatterproof1 (SHELL) shell thickness gene
cggcggggaagccaagtactttttyaggtcttcgaaggcctgttggcatt

SEQ ID NO: 5203 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttccccgacctgcggctttacgagyagcggcggggaagccaagtactttt

SEQ ID NO: 5204 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctcaggagatgtggccaagtagagrtacaaggtttccccgacctgcggct

SEQ ID NO: 5205 - DNA, 50 bp, Artificial Sequence
  synthetic Elaeis guineensis (oil palm) single nucleotide polymorphism (SNP) in genomic region adjacent to shatterproof1 (SHELL) shell thickness gene
cgagtaccgaactgatcgcctcagragatgtggccaagtagagatacaag

SEQ ID NO: 5206 - DNA, 50 bp, Artificial Sequence
  synthetic Elaeis guineensis (oil palm) single nucleotide polymorphism (SNP) in genomic region adjacent to shatterproof1 (SHELL) shell thickness gene
cgagaaaatgagtgccgaacccatyagcctatctactacaccagcaaggt

SEQ ID NO: 5207 - DNA, 50 bp, Artificial Sequence
  synthetic Elaeis guineensis (oil palm) single nucleotide polymorphism (SNP) in genomic region adjacent to shatterproof1 (SHELL) shell thickness gene
cactcattttctcggacgagtaccraactgatcgcctcaggagatgtggc

SEQ ID NO: 5208 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcggcactcattttctcggacgagyaccgaactgatcgcctcaggagatg

SEQ ID NO: 5209 - DNA, 50 bp, Artificial Sequence
  synthetic Elaeis guineensis (oil palm) single nucleotide polymorphism (SNP) in genomic region adjacent to shatterproof1 (SHELL) shell thickness gene
gataggctgatgggttcggcactcrttttctcggacgagtaccgaactga

SEQ ID NO: 5210 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggcgaaaatcatcttttccgtctcygagtaccttgcttcggccccgtgga

SEQ ID NO: 5211 - DNA, 50 bp, Artificial Sequence
  synthetic Elaeis guineensis (oil palm) single nucleotide polymorphism (SNP) in genomic region adjacent to shatterproof1 (SHELL) shell thickness gene
cgcgcaacgactccgtccatacttycaggcccacgccatagtggtgctca

SEQ ID NO: 5212 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcggcgcagtatcgccctcaggggytggttggtgagcaccactatggcgt

SEQ ID NO: 5213 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcttcatcgcccacttcgcgagtcrtccagatgtgtcgggtcggcgcagt

SEQ ID NO: 5214 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcggtactgaatgtcgaactcgctragcttcatcgcccacttcgcgagtc

SEQ ID NO: 5215 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgacagagctcattcaataattttygaagatcatggatgatgagatgtat

SEQ ID NO: 5216 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagccgtttccggataaatccctgracgaagagggaaatttcaatgaccc

SEQ ID NO: 5217 - DNA, 50 bp, Artificial Sequence
  synthetic Elaeis guineensis (oil palm) single nucleotide polymorphism (SNP) in genomic region adjacent to shatterproof1 (SHELL) shell thickness gene
cgttaaccagacccgttcgatctcrtctcagtggctccaatttcgtgttt

SEQ ID NO: 5218 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctggtgggaagcgaaggtggtgccrcgccgggaagtgaactcgagaaacc

SEQ ID NO: 5219 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttcagacactacagttataggctaraggtgaaccattgcattaagaacaa

SEQ ID NO: 5220 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaaattgcatgcttcaaagcatttrcctttccatttacaaaaatcaacag

SEQ ID NO: 5221 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaattatttaagaaaacttagggygaggaccacttgacatcaaatgctg

SEQ ID NO: 5222 - DNA, 50 bp, Artificial Sequence
  synthetic Elaeis guineensis (oil palm) single nucleotide polymorphism (SNP) in genomic region adjacent to shatterproof1 (SHELL) shell thickness gene
ataatgtgaaaatcagtgtagtgaraagtaaattataaataactagtgta

SEQ ID NO: 5223 - DNA, 50 bp, Artificial Sequence
  synthetic Elaeis guineensis (oil palm) single nucleotide polymorphism (SNP) in genomic region adjacent to shatterproof1 (SHELL) shell thickness gene
acacacacacacacacacacgtatrtattaacataatgtgaaaatcagtg

SEQ ID NO: 5224 - DNA, 50 bp, Artificial Sequence
  synthetic Elaeis guineensis (oil palm) single nucleotide polymorphism (SNP) in genomic region adjacent to shatterproof1 (SHELL) shell thickness gene
gttattagaattcctgttcaatgakattctttttccaaagaaccctaaca

SEQ ID NO: 5225 - DNA, 50 bp, Artificial Sequence
  synthetic Elaeis guineensis (oil palm) single nucleotide polymorphism (SNP) in genomic region adjacent to shatterproof1 (SHELL) shell thickness gene
cccacccaatgagttattagaattsctgttcaatgatattctttttccaa

SEQ ID NO: 5226 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttttttcagaatacaaggaatcctkagtttacttccgccaactcatacca

SEQ ID NO: 5227 - DNA, 50 bp, Artificial Sequence
  synthetic Elaeis guineensis (oil palm) single nucleotide polymorphism (SNP) in genomic region adjacent to shatterproof1 (SHELL) shell thickness gene
aacaaacattccggaacatgaactygtgctatataattgacttgaaaaat

SEQ ID NO: 5228 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccaagtcccaagtgtttggcattayaaagaatagaagatagactctagca

SEQ ID NO: 5229 - DNA, 50 bp, Artificial Sequence
  synthetic Elaeis guineensis (oil palm) single nucleotide polymorphism (SNP) in genomic region adjacent to shatterproof1 (SHELL) shell thickness gene
tccataaagtagaatattcaaatgycaaatagcataagcatatgacaatt

SEQ ID NO: 5230 - DNA, 50 bp, Artificial Sequence
  synthetic Elaeis guineensis (oil palm) single nucleotide polymorphism (SNP) in genomic region adjacent to shatterproof1 (SHELL) shell thickness gene
catgaataataggccaataccttcraaagaagagtggagggaaatcgtta

SEQ ID NO: 5231 - DNA, 50 bp, Artificial Sequence
  synthetic Elaeis guineensis (oil palm) single nucleotide polymorphism (SNP) in genomic region adjacent to shatterproof1 (SHELL) shell thickness gene
tccaatagggatggaagtcaaaatycgaaagagcctccttcatgaagcgc

SEQ ID NO: 5232 - DNA, 50 bp, Artificial Sequence
  synthetic Elaeis guineensis (oil palm) single nucleotide polymorphism (SNP) in genomic region adjacent to shatterproof1 (SHELL) shell thickness gene
actccaaacgtatgccatagtccartctatccaatagggatggaagtcaa

SEQ ID NO: 5233 - DNA, 50 bp, Artificial Sequence
  synthetic Elaeis guineensis (oil palm) single nucleotide polymorphism (SNP) in genomic region adjacent to shatterproof1 (SHELL) shell thickness gene
acagcacgaagagctcgcgaaaggrcatcagcacatataataaaaagata

SEQ ID NO: 5234 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaagccaatagcattccagaacgtrgcccatcccaacagcaagcaatcat

SEQ ID NO: 5235 - DNA, 50 bp, Artificial Sequence
  synthetic Elaeis guineensis (oil palm) single nucleotide polymorphism (SNP) in genomic region adjacent to shatterproof1 (SHELL) shell thickness gene
cgttatgctcggccacacctaaccratctcgaatcaagtgctgcaattgc

SEQ ID NO: 5236 - DNA, 50 bp, Artificial Sequence
  synthetic Elaeis guineensis (oil palm) single nucleotide polymorphism (SNP) in genomic region adjacent to shatterproof1 (SHELL) shell thickness gene
atccccaaatactgaagaaccccgytatgctcggccacacctaaccgatc

SEQ ID NO: 5237 - DNA, 50 bp, Artificial Sequence
  synthetic Elaeis guineensis (oil palm) single nucleotide polymorphism (SNP) in genomic region adjacent to shatterproof1 (SHELL) shell thickness gene
ataatgttcgaaagtaaataaacargcatagaagtgagaatggacctcat

SEQ ID NO: 5238 - DNA, 50 bp, Artificial Sequence
  synthetic Elaeis guineensis (oil palm) single nucleotide polymorphism (SNP) in genomic region adjacent to shatterproof1 (SHELL) shell thickness gene
catgctagcagatgtacaccaccayccctttagatttggaacgccacaag

SEQ ID NO: 5239 - DNA, 50 bp, Artificial Sequence
  synthetic Elaeis guineensis (oil palm) single nucleotide polymorphism (SNP) in genomic region adjacent to shatterproof1 (SHELL) shell thickness gene
tactagttggcagaccatatctcaygctagcagatgtacaccaccatccc

SEQ ID NO: 5240 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccttctatactagttggcagaccayatctcatgctagcagatgtacacca

SEQ ID NO: 5241 - DNA, 50 bp, Artificial Sequence
  synthetic Elaeis guineensis (oil palm) single nucleotide polymorphism (SNP) in genomic region adjacent to shatterproof1 (SHELL) shell thickness gene
atcatgctctacatcgactcagggycaagtagaagcttggcagtatgtcg

SEQ ID NO: 5242 - DNA, 50 bp, Artificial Sequence
  synthetic Elaeis guineensis (oil palm) single nucleotide polymorphism (SNP) in genomic region adjacent to shatterproof1 (SHELL) shell thickness gene
cgccgcatcatcatgctctacatcractcagggtcaagtagaagcttggc

SEQ ID NO: 5243 - DNA, 50 bp, Artificial Sequence
  synthetic Elaeis guineensis (oil palm) single nucleotide polymorphism (SNP) in genomic region adjacent to shatterproof1 (SHELL) shell thickness gene
aggaacacattaggggcatgcacayagatctcctaccatataactgaagc

SEQ ID NO: 5244 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgaaggaacacattaggggcatgcrcacagatctcctaccatataactga

SEQ ID NO: 5245 - DNA, 50 bp, Artificial Sequence
  synthetic Elaeis guineensis (oil palm) single nucleotide polymorphism (SNP) in genomic region adjacent to shatterproof1 (SHELL) shell thickness gene
taacatccgagccatgatgaaaagrtgtaggaatcctcagtactcatcgg

SEQ ID NO: 5246 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaagattaactctcgggtgcactcygagcctccaaatccatccaccatcc

SEQ ID NO: 5247 - DNA, 50 bp, Artificial Sequence
  synthetic Elaeis guineensis (oil palm) single nucleotide polymorphism (SNP) in genomic region adjacent to shatterproof1 (SHELL) shell thickness gene
cgcaaataagacctgatcgaaagayatctccaagctaccttccacaagaa

SEQ ID NO: 5248 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctagctggtatccaaatctctctcrcgcaaataagacctgatcgaaagat

SEQ ID NO: 5249 - DNA, 50 bp, Artificial Sequence
  synthetic Elaeis guineensis (oil palm) single nucleotide polymorphism (SNP) in genomic region adjacent to shatterproof1 (SHELL) shell thickness gene
cgtctcctcctccctagcacagcargaacactctagctggtatccaaatc

SEQ ID NO: 5250 - DNA, 50 bp, Artificial Sequence
  synthetic Elaeis guineensis (oil palm) single nucleotide polymorphism (SNP) in genomic region adjacent to shatterproof1 (SHELL) shell thickness gene
caccccctactcttgatcttagtcrgtctaagaaggccccaacaggatca

SEQ ID NO: 5251 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcagcattgataactacattgtggratagaacaccccctactcttgatct

SEQ ID NO: 5252 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgtggctctcttcaaaatgaaccawgccgaggtcattctggattcaaaaa

SEQ ID NO: 5253 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttcaccttaaagtacctcggaggaraggactcccaaatgataaacacctt

SEQ ID NO: 5254 - DNA, 50 bp, Artificial Sequence
  synthetic Elaeis guineensis (oil palm) single nucleotide polymorphism (SNP) in genomic region adjacent to shatterproof1 (SHELL) shell thickness gene
agagtacaaaacctgcacctccaarcctgccgtgaacgctaccatcaaag

SEQ ID NO: 5255 - DNA, 50 bp, Artificial Sequence
  synthetic Elaeis guineensis (oil palm) single nucleotide polymorphism (SNP) in genomic region adjacent to shatterproof1 (SHELL) shell thickness gene
acgtcgcaacctaatcaactatacmgttggccttccggagagcatgtcgg

SEQ ID NO: 5256 - DNA, 50 bp, Artificial Sequence
  synthetic Elaeis guineensis (oil palm) single nucleotide polymorphism (SNP) in genomic region adjacent to shatterproof1 (SHELL) shell thickness gene
aacctcggatcagtctccaaaaatycatcggagtgttccacaacgaacgt

SEQ ID NO: 5257 - DNA, 50 bp, Artificial Sequence
  synthetic Elaeis guineensis (oil palm) single nucleotide polymorphism (SNP) in genomic region adjacent to shatterproof1 (SHELL) shell thickness gene
cagaaagtgaaacatccttgaaagrccaaggaatcaacctcggatcagtc

SEQ ID NO: 5258 - DNA, 50 bp, Artificial Sequence
  synthetic Elaeis guineensis (oil palm) single nucleotide polymorphism (SNP) in genomic region adjacent to shatterproof1 (SHELL) shell thickness gene
atacggaaatcaaacatccacggtstagggtgactctacgagtccaaata

SEQ ID NO: 5259 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaagttctagaaaggtaataaactygttttgaaatatgccgagagtacga

SEQ ID NO: 5260 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaaagaatgaggtagaaaagcattycttgaaaagaaagttctttctacca

SEQ ID NO: 5261 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcgatctgatagatcgctacaaatygatttatgaataatgataaattttc

SEQ ID NO: 5262 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaatgtacaattctgcggtttcctwagtcatcaattgtgggcattttttt

SEQ ID NO: 5263 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaccttcccatccttcgttgtaagmagtcttattgttgtatatgaatgta

SEQ ID NO: 5264 - DNA, 50 bp, Artificial Sequence
  synthetic Elaeis guineensis (oil palm) single nucleotide polymorphism (SNP) in genomic region adjacent to shatterproof1 (SHELL) shell thickness gene
ataatttgattcctaaagcttcccyagcagcacctttcattcatgtatta

SEQ ID NO: 5265 - DNA, 50 bp, Artificial Sequence
  synthetic Elaeis guineensis (oil palm) single nucleotide polymorphism (SNP) in genomic region adjacent to shatterproof1 (SHELL) shell thickness gene
tattaatctcatctgaatggtatcrtgtaaagattagattatatcaacaa

SEQ ID NO: 5266 - DNA, 50 bp, Artificial Sequence
  synthetic Elaeis guineensis (oil palm) single nucleotide polymorphism (SNP) in genomic region adjacent to shatterproof1 (SHELL) shell thickness gene
tggccaaacgttagcagaaccctaycagttgccacccctatactgtgtgc

SEQ ID NO: 5267 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggctttcggatggatatggccaaaygttagcagaaccctaccagttgcca

SEQ ID NO: 5268 - DNA, 50 bp, Artificial Sequence
  synthetic Elaeis guineensis (oil palm) single nucleotide polymorphism (SNP) in genomic region adjacent to shatterproof1 (SHELL) shell thickness gene
tggatatggatgtaggattatagayaggggttgggtctgacatatgtact

SEQ ID NO: 5269 - DNA, 50 bp, Artificial Sequence
  synthetic Elaeis guineensis (oil palm) single nucleotide polymorphism (SNP) in genomic region adjacent to shatterproof1 (SHELL) shell thickness gene
cactgttttacaagtagtgttccarcaatcctaacttgtatgccttatca

SEQ ID NO: 5270 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgacttcggttgcctcttcttctaygtggattaactgatgcaaagtgatc

SEQ ID NO: 5271 - DNA, 50 bp, Artificial Sequence
  synthetic Elaeis guineensis (oil palm) single nucleotide polymorphism (SNP) in genomic region adjacent to shatterproof1 (SHELL) shell thickness gene
catgctttggcagtcatctgacttyggttgcctcttcttctacgtggatt

SEQ ID NO: 5272 - DNA, 50 bp, Artificial Sequence
  synthetic Elaeis guineensis (oil palm) single nucleotide polymorphism (SNP) in genomic region adjacent to shatterproof1 (SHELL) shell thickness gene
caaaagctattctctttagcttgckgaggcatcattacttttcctcttca

SEQ ID NO: 5273 - DNA, 50 bp, Artificial Sequence
  synthetic Elaeis guineensis (oil palm) single nucleotide polymorphism (SNP) in genomic region adjacent to shatterproof1 (SHELL) shell thickness gene
cattcaagtgtataatagttccttytgtagtttctacaaatctcaggatc

SEQ ID NO: 5274 - DNA, 50 bp, Artificial Sequence
  synthetic Elaeis guineensis (oil palm) single nucleotide polymorphism (SNP) in genomic region adjacent to shatterproof1 (SHELL) shell thickness gene
aactaatctctccctctctctctcyaacaagtccatttaacattttaatt

SEQ ID NO: 5275 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaatattcgatgtcataccagattytctaccatcataatacaaaataatg

SEQ ID NO: 5276 - DNA, 50 bp, Artificial Sequence
  synthetic Elaeis guineensis (oil palm) single nucleotide polymorphism (SNP) in genomic region adjacent to shatterproof1 (SHELL) shell thickness gene
cacttctggccttatagtttgaatrttgtgggaataaggccttatagttt

SEQ ID NO: 5277 - DNA, 50 bp, Artificial Sequence
  synthetic Elaeis guineensis (oil palm) single nucleotide polymorphism (SNP) in genomic region adjacent to shatterproof1 (SHELL) shell thickness gene
tggtacctgtgagattctccaaaaygtatcctcttagtttatattagctc

SEQ ID NO: 5278 - DNA, 50 bp, Artificial Sequence
  synthetic Elaeis guineensis (oil palm) single nucleotide polymorphism (SNP) in genomic region adjacent to shatterproof1 (SHELL) shell thickness gene
atttcattccgtgattgcactcctrctcttcttatctgaaattcgaagat

SEQ ID NO: 5279 - DNA, 50 bp, Artificial Sequence
  synthetic Elaeis guineensis (oil palm) single nucleotide polymorphism (SNP) in genomic region adjacent to shatterproof1 (SHELL) shell thickness gene
accaaagaaataatgaacaccgatwagagttctagatatcgagaaaagga

SEQ ID NO: 5280 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcattactgtccatcatggaatacyataccgtcccataccgcccgtagca

SEQ ID NO: 5281 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaccaaaattatatgatactttctmatagtttagaacagaaaatactaca

SEQ ID NO: 5282 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgagccaaatcacatgtagagaggyaagtggttgcgggtgctggggactt

SEQ ID NO: 5283 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcagttgtagaatatatgaaagaakggtgcatgtaattgttgtaagcttg

SEQ ID NO: 5284 - DNA, 50 bp, Artificial Sequence
  synthetic Elaeis guineensis (oil palm) single nucleotide polymorphism (SNP) in genomic region adjacent to shatterproof1 (SHELL) shell thickness gene
cttttatggaatttcggttgaatcrtgatacagcacagccttctgcactt

SEQ ID NO: 5285 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttggaggattattaacttgtctartctttgaccacaacttggtggaaag

SEQ ID NO: 5286 - DNA, 50 bp, Artificial Sequence
  synthetic Elaeis guineensis (oil palm) single nucleotide polymorphism (SNP) in genomic region adjacent to shatterproof1 (SHELL) shell thickness gene
cataagggcatagcattccaacaaytatttatacttcagaattcaggtgg

SEQ ID NO: 5287 - DNA, 50 bp, Artificial Sequence
  synthetic Elaeis guineensis (oil palm) single nucleotide polymorphism (SNP) in genomic region adjacent to shatterproof1 (SHELL) shell thickness gene
catccacctgttcattttcggtagytataattccaccaaagaattgatat

SEQ ID NO: 5288 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcagagattggtgattgttagactkatcaccattttgcacttcagcttct

SEQ ID NO: 5289 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttgggtagccaagatcaaccaattrtaagtgggtggggtatggatttgac

SEQ ID NO: 5290 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttatatttagtgttaattcattatwgttgttcttgaactttttactgttt

SEQ ID NO: 5291 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccggccggcacgagttccaataccragtccgcgaatcttgattcaatatt

SEQ ID NO: 5292 - DNA, 50 bp, Artificial Sequence
  synthetic Elaeis guineensis (oil palm) single nucleotide polymorphism (SNP) in genomic region adjacent to shatterproof1 (SHELL) shell thickness gene
gagcgcccttgtttcatgcttgcarcaccacaggtatcaagtgcgccgtt

SEQ ID NO: 5293 - DNA, 50 bp, Artificial Sequence
  synthetic Elaeis guineensis (oil palm) single nucleotide polymorphism (SNP) in genomic region adjacent to shatterproof1 (SHELL) shell thickness gene
gctatcgaagggcgtcgggtcgctrccgtggccaccgcccaccgggcagc

SEQ ID NO: 5294 - DNA, 50 bp, Artificial Sequence
  synthetic Elaeis guineensis (oil palm) single nucleotide polymorphism (SNP) in genomic region adjacent to shatterproof1 (SHELL) shell thickness gene
gatcgtattggagggaggagcgaayggtggaggagctatcgaagggcgtc

SEQ ID NO: 5295 - DNA, 50 bp, Artificial Sequence
  synthetic Elaeis guineensis (oil palm) single nucleotide polymorphism (SNP) in genomic region adjacent to shatterproof1 (SHELL) shell thickness gene
agagagagagggagagcgatcgtaytggagggaggagcgaacggtggagg

SEQ ID NO: 5296 - DNA, 50 bp, Artificial Sequence
  synthetic Elaeis guineensis (oil palm) single nucleotide polymorphism (SNP) in genomic region adjacent to shatterproof1 (SHELL) shell thickness gene
atcacgacgccgtcggaggccgacrgtggcctgctgtggccatcagaggg

SEQ ID NO: 5297 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcaaaaagaatggcaatctaatatratcattcaatacataaaatttcgta

SEQ ID NO: 5298 - DNA, 50 bp, Artificial Sequence
  synthetic Elaeis guineensis (oil palm) single nucleotide polymorphism (SNP) in genomic region adjacent to shatterproof1 (SHELL) shell thickness gene
gctttttgtactttatgccgacaaygttgtggatgactcagtaaggtgtg

SEQ ID NO: 5299 - DNA, 50 bp, Artificial Sequence
  synthetic Elaeis guineensis (oil palm) single nucleotide polymorphism (SNP) in genomic region adjacent to shatterproof1 (SHELL) shell thickness gene
gggattactaacacttcaaaggaaycttaatgaactctccttaatttagt

SEQ ID NO: 5300 - DNA, 50 bp, Artificial Sequence
  synthetic Elaeis guineensis (oil palm) single nucleotide polymorphism (SNP) in genomic region adjacent to shatterproof1 (SHELL) shell thickness gene
cattttctatgctctcaagggcatkctgggattactaacacttcaaagga

SEQ ID NO: 5301 - DNA, 50 bp, Artificial Sequence
  synthetic Elaeis guineensis (oil palm) single nucleotide polymorphism (SNP) in genomic region adjacent to shatterproof1 (SHELL) shell thickness gene
cctatacctggtcatgtccttttckcaataaattataacaagcaagagac

SEQ ID NO: 5302 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggagttttggaaggagaaataaacrtactctaggggaaggtcaaaggaac

SEQ ID NO: 5303 - DNA, 50 bp, Artificial Sequence
  synthetic Elaeis guineensis (oil palm) single nucleotide polymorphism (SNP) in genomic region adjacent to shatterproof1 (SHELL) shell thickness gene
gttgaatatatgacttaaagacaawatctggaacaaaaaaaagaaaaatg

SEQ ID NO: 5304 - DNA, 50 bp, Artificial Sequence
  synthetic Elaeis guineensis (oil palm) single nucleotide polymorphism (SNP) in genomic region adjacent to shatterproof1 (SHELL) shell thickness gene
caatctggcacaacctggtcttctrctctatttgcacctttctcttcaaa

SEQ ID NO: 5305 - DNA, 50 bp, Artificial Sequence
  synthetic Elaeis guineensis (oil palm) single nucleotide polymorphism (SNP) in genomic region adjacent to shatterproof1 (SHELL) shell thickness gene
atccaccaagctagccatcttggamgaagaaacatagatcaacaccattc

SEQ ID NO: 5306 - DNA, 50 bp, Artificial Sequence
  synthetic Elaeis guineensis (oil palm) single nucleotide polymorphism (SNP) in genomic region adjacent to shatterproof1 (SHELL) shell thickness gene
taattcttccttctcttgtggctaratagtttctctgctaatatgtttgt

SEQ ID NO: 5307 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtccccttattaaagaatcattaasgttaaaaaaatgcaactccgttcgg

SEQ ID NO: 5308 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctcgttgctggtaggctttgtgtycccttattaaagaatcattaaggtt

SEQ ID NO: 5309 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccatcccgcctcttctctccctgcygtcggctcggctgccgttctctctt

SEQ ID NO: 5310 - DNA, 50 bp, Artificial Sequence
  synthetic Elaeis guineensis (oil palm) single nucleotide polymorphism (SNP) in genomic region adjacent to shatterproof1 (SHELL) shell thickness gene
acttgagctatccgaagagaaacartttttctttccttcaaattaaacta

SEQ ID NO: 5311 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttcttatagcgtctggcatgtatrcaaagtagaggatctgcacatccag

SEQ ID NO: 5312 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttgcgaagatcgaagtttatcctgytttcttatagcgtctggcatgtata

SEQ ID NO: 5313 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggtgtcacaccagtatatcttctcyctcgtttgattgggttgcgaagatc

SEQ ID NO: 5314 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgagttaggagtcctatatttattrgatcatgggattcatctataaatag

SEQ ID NO: 5315 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctcttatgggccgaccaacacctgraagcttccttattgtggacgtccca

SEQ ID NO: 5316 - DNA, 50 bp, Artificial Sequence
  synthetic Elaeis guineensis (oil palm) single nucleotide polymorphism (SNP) in genomic region adjacent to shatterproof1 (SHELL) shell thickness gene
attcgaatcggacccattttggatratatatgagaaatccttcttgcatt

SEQ ID NO: 5317 - DNA, 50 bp, Artificial Sequence
  synthetic Elaeis guineensis (oil palm) single nucleotide polymorphism (SNP) in genomic region adjacent to shatterproof1 (SHELL) shell thickness gene
taaaattgacagcctttcgaaattrtttcgaaccagcttcgaattgaatt

SEQ ID NO: 5318 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtactaattaattttagattatatytaaattaattagacttaattggatc

SEQ ID NO: 5319 - DNA, 50 bp, Artificial Sequence
  synthetic Elaeis guineensis (oil palm) single nucleotide polymorphism (SNP) in genomic region adjacent to shatterproof1 (SHELL) shell thickness gene
atatgatctatggagtatatgaaakattggatttaagtactaattaattt

SEQ ID NO: 5320 - DNA, 50 bp, Artificial Sequence
  synthetic Elaeis guineensis (oil palm) single nucleotide polymorphism (SNP) in genomic region adjacent to shatterproof1 (SHELL) shell thickness gene
cacatgaggttcaagttcgatcacrgagatgaacagttttcgatatatga

SEQ ID NO: 5321 - DNA, 50 bp, Artificial Sequence
  synthetic Elaeis guineensis (oil palm) single nucleotide polymorphism (SNP) in genomic region adjacent to shatterproof1 (SHELL) shell thickness gene
gagaattaagttatggatcgaatgrgattgaagagttgactatgtctagc

SEQ ID NO: 5322 - DNA, 50 bp, Artificial Sequence
  synthetic Elaeis guineensis (oil palm) single nucleotide polymorphism (SNP) in genomic region adjacent to shatterproof1 (SHELL) shell thickness gene
agtcacacacacaagtcaaacaccrtaggaaagaattagcttatatttat

SEQ ID NO: 5323 - DNA, 50 bp, Artificial Sequence
  synthetic Elaeis guineensis (oil palm) single nucleotide polymorphism (SNP) in genomic region adjacent to shatterproof1 (SHELL) shell thickness gene
agtacagaagtcggttcctgtgctrctggcttagtatttaaacctatgga

SEQ ID NO: 5324 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtatagattttgaaatatttttttrtgataatttgacctatttggacgtc

SEQ ID NO: 5325 - DNA, 50 bp, Artificial Sequence
  synthetic Elaeis guineensis (oil palm) single nucleotide polymorphism (SNP) in genomic region adjacent to shatterproof1 (SHELL) shell thickness gene
cagggtcaaaagaatgaattatacrgtaaccatgtgtatagattttgaaa

SEQ ID NO: 5326 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatctgaaaccatcctagagcattyagggtcaaaagaatgaattatacgg

SEQ ID NO: 5327 - DNA, 50 bp, Artificial Sequence
  synthetic Elaeis guineensis (oil palm) single nucleotide polymorphism (SNP) in genomic region adjacent to shatterproof1 (SHELL) shell thickness gene
attgacagttaatctgaaaccatcmtagagcattcagggtcaaaagaatg

SEQ ID NO: 5328 - DNA, 50 bp, Artificial Sequence
  synthetic Elaeis guineensis (oil palm) single nucleotide polymorphism (SNP) in genomic region adjacent to shatterproof1 (SHELL) shell thickness gene
cttaatcaggataatctatgagatrgatttgaaaggttgaaatacaatgt

SEQ ID NO: 5329 - DNA, 50 bp, Artificial Sequence
  synthetic Elaeis guineensis (oil palm) single nucleotide polymorphism (SNP) in genomic region adjacent to shatterproof1 (SHELL) shell thickness gene
atatgtagatcaaaatgggattgaycccttcagattattggagttgatgt

SEQ ID NO: 5330 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatagttaagtacttgtgaagtctrtatgtagatcaaaatgggattgatc

SEQ ID NO: 5331 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagtatctttcagttctaagatcaycatagtgacttgcaaataattctgt

SEQ ID NO: 5332 - DNA, 50 bp, Artificial Sequence
  synthetic Elaeis guineensis (oil palm) single nucleotide polymorphism (SNP) in genomic region adjacent to shatterproof1 (SHELL) shell thickness gene
caaggactgtggtgacactgatatracatacaggtgtgatataggagtac

SEQ ID NO: 5333 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgatacgtcattatagaatgctaayatttatcgagtggaagtcattgtgt

SEQ ID NO: 5334 - DNA, 50 bp, Artificial Sequence
  synthetic Elaeis guineensis (oil palm) single nucleotide polymorphism (SNP) in genomic region adjacent to shatterproof1 (SHELL) shell thickness gene
agtccttagaactatattagtgtaygataaagagagaatttatcgtatag

SEQ ID NO: 5335 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgaactcttgtattgtgatgaagtycttagaactatattagtgtatgata

SEQ ID NO: 5336 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgataaatgaataaaaattattctracattttttcatcacaaagttatat

SEQ ID NO: 5337 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatggaagatgggtataagatactrccccgattgactttagtccaagttg

SEQ ID NO: 5338 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccgacccctttactaaagctctcgrgatcaaagcgttcgatgacttcaaa

SEQ ID NO: 5339 - DNA, 50 bp, Artificial Sequence
  synthetic Elaeis guineensis (oil palm) single nucleotide polymorphism (SNP) in genomic region adjacent to shatterproof1 (SHELL) shell thickness gene
caatagaaaggagaacctagccgayccctttactaaagctctcgggatca

SEQ ID NO: 5340 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcatcagatattgcaaaatattctrcatcgctattacttggtgcgagaga

SEQ ID NO: 5341 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctgtatgcaaaacagaatacaatrctgcatcagatattgcaaaatattc

SEQ ID NO: 5342 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagaatttcaagcaacatactgtgrtcgattctgtatgcaaaacagaata

SEQ ID NO: 5343 - DNA, 50 bp, Artificial Sequence
  synthetic Elaeis guineensis (oil palm) single nucleotide polymorphism (SNP) in genomic region adjacent to shatterproof1 (SHELL) shell thickness gene
taatggaggagctatttgtcagaaraatttcaagcaacatactgtgatcg

SEQ ID NO: 5344 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttatgatgacagcagaagcgtgtcragctatgtatttatcttaatggagg

SEQ ID NO: 5345 - DNA, 50 bp, Artificial Sequence
  synthetic Elaeis guineensis (oil palm) single nucleotide polymorphism (SNP) in genomic region adjacent to shatterproof1 (SHELL) shell thickness gene
cggcaactcctgaggagagagcgcrtatgagtacaataccatatactttg

SEQ ID NO: 5346 - DNA, 50 bp, Artificial Sequence
  synthetic Elaeis guineensis (oil palm) single nucleotide polymorphism (SNP) in genomic region adjacent to shatterproof1 (SHELL) shell thickness gene
actcttttcaaaaaagattgtccgrcaactcctgaggagagagcgcatat

SEQ ID NO: 5347 - DNA, 50 bp, Artificial Sequence
  synthetic Elaeis guineensis (oil palm) single nucleotide polymorphism (SNP) in genomic region adjacent to shatterproof1 (SHELL) shell thickness gene
agggataaatttagaagattgcttrgattatcctaatccatgtacatcaa

SEQ ID NO: 5348 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaatgaagatctatagggataaatytagaagattgcttggattatcctaa

SEQ ID NO: 5349 - DNA, 50 bp, Artificial Sequence
  synthetic Elaeis guineensis (oil palm) single nucleotide polymorphism (SNP) in genomic region adjacent to shatterproof1 (SHELL) shell thickness gene
agtgtaaagctatagttatcatcayagtttttcatgaagaacttgggaga

SEQ ID NO: 5350 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatgtggatgatatactgttactaraaaatgacatcccgactttgtagag

SEQ ID NO: 5351 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgtactatatgtggatgatatactrttactagaaaatgacatcccgactt

SEQ ID NO: 5352 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctttgcgtctacaagtgggcttccrattctgtagtcatctttcttgtact

SEQ ID NO: 5353 - DNA, 50 bp, Artificial Sequence
  synthetic Elaeis guineensis (oil palm) single nucleotide polymorphism (SNP) in genomic region adjacent to shatterproof1 (SHELL) shell thickness gene
acaagctaaataggtctatttatgracttaaacaggcgtctagaagttgg

SEQ ID NO: 5354 - DNA, 50 bp, Artificial Sequence
  synthetic Elaeis guineensis (oil palm) single nucleotide polymorphism (SNP) in genomic region adjacent to shatterproof1 (SHELL) shell thickness gene
catccatagatgagtcgaaaatgtrcaagctaaataggtctatttatgga

SEQ ID NO: 5355 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctggaagaagaggtgtatatgatayaatctgaagggttcacatccataga

SEQ ID NO: 5356 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcctgtggcaatgctcaagtccatycgaattttgtttgctatcgctgcac

SEQ ID NO: 5357 - DNA, 50 bp, Artificial Sequence
  synthetic Elaeis guineensis (oil palm) single nucleotide polymorphism (SNP) in genomic region adjacent to shatterproof1 (SHELL) shell thickness gene
tataaagctcgtctaattactaagrtttaccatcaacattatggtattga

SEQ ID NO: 5358 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtatggacactaattgatccatctraagggataaaattcataggatgtaa

SEQ ID NO: 5359 - DNA, 50 bp, Artificial Sequence
  synthetic Elaeis guineensis (oil palm) single nucleotide polymorphism (SNP) in genomic region adjacent to shatterproof1 (SHELL) shell thickness gene
gagatggagtctatggagatccatrgtgtatggacactaattgatccatc

SEQ ID NO: 5360 - DNA, 50 bp, Artificial Sequence
  synthetic Elaeis guineensis (oil palm) single nucleotide polymorphism (SNP) in genomic region adjacent to shatterproof1 (SHELL) shell thickness gene
gggcccgactctcagaaatggcttraggccataaagtccgagatggagtc

SEQ ID NO: 5361 - DNA, 50 bp, Artificial Sequence
  synthetic Elaeis guineensis (oil palm) single nucleotide polymorphism (SNP) in genomic region adjacent to shatterproof1 (SHELL) shell thickness gene
tggatagatactatgatttttttgrtccagaatgatgattccattaaatt

SEQ ID NO: 5362 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatcaaatctggagccaatagaggygctattaaggagatccggtagagta

SEQ ID NO: 5363 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttgattgatgaatcaaatctggagycaatagaggtgctattaaggagatc

SEQ ID NO: 5364 - DNA, 50 bp, Artificial Sequence
  synthetic Elaeis guineensis (oil palm) single nucleotide polymorphism (SNP) in genomic region adjacent to shatterproof1 (SHELL) shell thickness gene
gacacacacagaattgaatttgatygatgaatcaaatctggagccaatag

SEQ ID NO: 5365 - DNA, 50 bp, Artificial Sequence
  synthetic Elaeis guineensis (oil palm) single nucleotide polymorphism (SNP) in genomic region adjacent to shatterproof1 (SHELL) shell thickness gene
agttctttagtgaaagagctaatgyctgtaaaattgaatttgatgaagtt

SEQ ID NO: 5366 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtttgcagttggacagtctttttgraaaaagagttctttagtgaaagagc

SEQ ID NO: 5367 - DNA, 50 bp, Artificial Sequence
  synthetic Elaeis guineensis (oil palm) single nucleotide polymorphism (SNP) in genomic region adjacent to shatterproof1 (SHELL) shell thickness gene
cgataaaactctatatgagatatgracttggcgtaagccggtgctctcac

SEQ ID NO: 5368 - DNA, 50 bp, Artificial Sequence
  synthetic Elaeis guineensis (oil palm) single nucleotide polymorphism (SNP) in genomic region adjacent to shatterproof1 (SHELL) shell thickness gene
tagagatatgctcttgaaactgccygttatattttgaataaagtgccgag

SEQ ID NO: 5369 - DNA, 50 bp, Artificial Sequence
  synthetic Elaeis guineensis (oil palm) single nucleotide polymorphism (SNP) in genomic region adjacent to shatterproof1 (SHELL) shell thickness gene
cacaacataatgcgatatctaaaargaaaaatcaaatcttgttagatatg

SEQ ID NO: 5370 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctcttggagcaccacaacataatgygatatctaaaaggaaaaatcaaatc

SEQ ID NO: 5371 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaagtagagaaatagattggaaagrgtattaagacccttcggtcagaccg

SEQ ID NO: 5372 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatttgaaatattcaaatgatttcrtgctgaagtagagaaatagattgga

SEQ ID NO: 5373 - DNA, 50 bp, Artificial Sequence
  synthetic Elaeis guineensis (oil palm) single nucleotide polymorphism (SNP) in genomic region adjacent to shatterproof1 (SHELL) shell thickness gene
gatgacctatcgaggtatgagtatrtctatcttatgaagcataaatcaaa

SEQ ID NO: 5374 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttacagatgacctatcgaggtatsagtatgtctatcttatgaagcataa

SEQ ID NO: 5375 - DNA, 50 bp, Artificial Sequence
  synthetic Elaeis guineensis (oil palm) single nucleotide polymorphism (SNP) in genomic region adjacent to shatterproof1 (SHELL) shell thickness gene
taatacatactgatgtatgcggatytatgaacataagtgccagaggagga

SEQ ID NO: 5376 - DNA, 50 bp, Artificial Sequence
  synthetic Elaeis guineensis (oil palm) single nucleotide polymorphism (SNP) in genomic region adjacent to shatterproof1 (SHELL) shell thickness gene
gatctaatacatactgatgtatgcrgatctatgaacataagtgccagagg

SEQ ID NO: 5377 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctacttggtaagatgactaagtcaycttttaagagaaaaggtgaaagagc

SEQ ID NO: 5378 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgagatagatgattgtgaatcattrccaacctacgaatctcgtctacttg

SEQ ID NO: 5379 - DNA, 50 bp, Artificial Sequence
  synthetic Elaeis guineensis (oil palm) single nucleotide polymorphism (SNP) in genomic region adjacent to shatterproof1 (SHELL) shell thickness gene
atatcctaaattagataatgtcagygaatcctacctttggcattgtagac

SEQ ID NO: 5380 - DNA, 50 bp, Artificial Sequence
  synthetic Elaeis guineensis (oil palm) single nucleotide polymorphism (SNP) in genomic region adjacent to shatterproof1 (SHELL) shell thickness gene
cacgacctgttagtataatgtacarccaacaaatatcctaaattagataa

SEQ ID NO: 5381 - DNA, 50 bp, Artificial Sequence
  synthetic Elaeis guineensis (oil palm) single nucleotide polymorphism (SNP) in genomic region adjacent to shatterproof1 (SHELL) shell thickness gene
gatttttatgatatcattatgaatratactgcaattatgtgtggataatt

SEQ ID NO: 5382 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttataataaaggatgatttttatratatcattatgaataatactgcaat

SEQ ID NO: 5383 - DNA, 50 bp, Artificial Sequence
  synthetic Elaeis guineensis (oil palm) single nucleotide polymorphism (SNP) in genomic region adjacent to shatterproof1 (SHELL) shell thickness gene
gccttttggccaaacttagttacargtttataataaaggatgatttttat

SEQ ID NO: 5384 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatatcatctctgtaggccttttgrccaaacttagttacaagtttataat

SEQ ID NO: 5385 - DNA, 50 bp, Artificial Sequence
  synthetic Elaeis guineensis (oil palm) single nucleotide polymorphism (SNP) in genomic region adjacent to shatterproof1 (SHELL) shell thickness gene
cagcttgtcttctaatccagtagtrtcatgttagataattatcactattg

SEQ ID NO: 5386 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttcagttctagtcttgaaaactttrcagcttgtcttctaatccagtagtg

SEQ ID NO: 5387 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaaaaagatacagaaatcccatgcyaccgatcctaagcagagtaaatcat

SEQ ID NO: 5388 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaaagaaaaagatacagaaatccyatgccaccgatcctaagcagagtaa

SEQ ID NO: 5389 - DNA, 50 bp, Artificial Sequence
  synthetic Elaeis guineensis (oil palm) single nucleotide polymorphism (SNP) in genomic region adjacent to shatterproof1 (SHELL) shell thickness gene
aggagttagtgaatttagtgagagrattatctacaggacatcgatccttt

SEQ ID NO: 5390 - DNA, 50 bp, Artificial Sequence
  synthetic Elaeis guineensis (oil palm) single nucleotide polymorphism (SNP) in genomic region adjacent to shatterproof1 (SHELL) shell thickness gene
cagaaggagttagtgaatttagtgrgaggattatctacaggacatcgatc

SEQ ID NO: 5391 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaggctttagtcaccaatcatgtamtgtacataattgagcagattgaata

SEQ ID NO: 5392 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcagctatgaatgacaaacttagtygtaagttcaaagatgcgcaggtaga

SEQ ID NO: 5393 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaacctacagtcaatgctcctcgtrccgtgagagatacttacatgaagtg

SEQ ID NO: 5394 - DNA, 50 bp, Artificial Sequence
  synthetic Elaeis guineensis (oil palm) single nucleotide polymorphism (SNP) in genomic region adjacent to shatterproof1 (SHELL) shell thickness gene
agaattaatgtaattttcgaattgraggtagaggctatcaattcataaaa

SEQ ID NO: 5395 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctagtacccactaaagaattaatrtaattttcgaattggaggtagaggc

SEQ ID NO: 5396 - DNA, 50 bp, Artificial Sequence
  synthetic Elaeis guineensis (oil palm) single nucleotide polymorphism (SNP) in genomic region adjacent to shatterproof1 (SHELL) shell thickness gene
cacagtcagatccgaatgcagtctrtgtggattctagtacccactaaaga

SEQ ID NO: 5397 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggggtaaaacctaattgctagaaaktatttgaaaaaataattgattatga

SEQ ID NO: 5398 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcctggggtaaaacctaattgctaraaattatttgaaaaaataattgatt

SEQ ID NO: 5399 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctcaggttgatcgagccacactcgratttgaatatccatttgttagatac

SEQ ID NO: 5400 - DNA, 50 bp, Artificial Sequence
  synthetic Elaeis guineensis (oil palm) single nucleotide polymorphism (SNP) in genomic region adjacent to shatterproof1 (SHELL) shell thickness gene
cattcatcatatgaccatcatgatrtactttcagatcaatactcaggttg

SEQ ID NO: 5401 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttgatcatagcctcctattaaggtrcgtgataatgagtcgaatatttcaa

SEQ ID NO: 5402 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctatataacttgatgaagttagtgrgaggatttgcagcttgtaggtcatc

SEQ ID NO: 5403 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttgattaggtcactagtctattcrtgcagacccatgctattaaggtgaa

SEQ ID NO: 5404 - DNA, 50 bp, Artificial Sequence
  synthetic Elaeis guineensis (oil palm) single nucleotide polymorphism (SNP) in genomic region adjacent to shatterproof1 (SHELL) shell thickness gene
gatcatggctccgtggttgagcccraatcttctgatggaccaaatcgaaa

SEQ ID NO: 5405 - DNA, 50 bp, Artificial Sequence
  synthetic Elaeis guineensis (oil palm) single nucleotide polymorphism (SNP) in genomic region adjacent to shatterproof1 (SHELL) shell thickness gene
catgatcatggctccgtggttgagyccgaatcttctgatggaccaaatcg

SEQ ID NO: 5406 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttgatcaagtccatatgtttgatcytaataaatggatcatgatcatggct

SEQ ID NO: 5407 - DNA, 50 bp, Artificial Sequence
  synthetic Elaeis guineensis (oil palm) single nucleotide polymorphism (SNP) in genomic region adjacent to shatterproof1 (SHELL) shell thickness gene
caaaggattagtttgaatcagatcyttttaatgggttagacctagggtta

SEQ ID NO: 5408 - DNA, 50 bp, Artificial Sequence
  synthetic Elaeis guineensis (oil palm) single nucleotide polymorphism (SNP) in genomic region adjacent to shatterproof1 (SHELL) shell thickness gene
acagattaaaatacatgtttgacayaattttgaattaagctttgaatgat

SEQ ID NO: 5409 - DNA, 50 bp, Artificial Sequence
  synthetic Elaeis guineensis (oil palm) single nucleotide polymorphism (SNP) in genomic region adjacent to shatterproof1 (SHELL) shell thickness gene
gatcatacctatatatgtttaattrttgaacatattataaaaatttattt

SEQ ID NO: 5410 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttatcatgatgcatgagatgtatgwatgaagtttagatcatacctatata

SEQ ID NO: 5411 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaacaaatttttatatattattttratcaaaatatatttagattagattt

SEQ ID NO: 5412 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctcttttatctattcgatgggttytcttatgatgtgtaggggtgtcatt

SEQ ID NO: 5413 - DNA, 50 bp, Artificial Sequence
  synthetic Elaeis guineensis (oil palm) single nucleotide polymorphism (SNP) in genomic region adjacent to shatterproof1 (SHELL) shell thickness gene
atcatagagattaatttctcttttrtctattcgatgggttctcttatgat

SEQ ID NO: 5414 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttgatgagatcactaaaccatccgrtcataagagatcatagagattaatt

SEQ ID NO: 5415 - DNA, 50 bp, Artificial Sequence
  synthetic Elaeis guineensis (oil palm) single nucleotide polymorphism (SNP) in genomic region adjacent to shatterproof1 (SHELL) shell thickness gene
tataattaataagatcaaggatatrttcatgacataaaaattattttatc

SEQ ID NO: 5416 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatattttataatcagtataagatrtgtttcagatttgatatgatgtatc

SEQ ID NO: 5417 - DNA, 50 bp, Artificial Sequence
  synthetic Elaeis guineensis (oil palm) single nucleotide polymorphism (SNP) in genomic region adjacent to shatterproof1 (SHELL) shell thickness gene
cgcaaaaatagattttatcagaaayttattcctcatacattcatgtttgc

SEQ ID NO: 5418 - DNA, 50 bp, Artificial Sequence
  synthetic Elaeis guineensis (oil palm) single nucleotide polymorphism (SNP) in genomic region adjacent to shatterproof1 (SHELL) shell thickness gene
aacccctctccagtgtcaaagtctragtcccctccttcaatgattttaat

SEQ ID NO: 5419 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgctcccgtaactctatatcgaacrcccacaacccctctccagtgtcaaa

SEQ ID NO: 5420 - DNA, 50 bp, Artificial Sequence
  synthetic Elaeis guineensis (oil palm) single nucleotide polymorphism (SNP) in genomic region adjacent to shatterproof1 (SHELL) shell thickness gene
gagacataaatacatcaggcatctyagtccataatgagtttgagtctgct

SEQ ID NO: 5421 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctaatttttatagtaatttctgtytagtcaatttggtgaggagttgatg

SEQ ID NO: 5422 - DNA, 50 bp, Artificial Sequence
  synthetic Elaeis guineensis (oil palm) single nucleotide polymorphism (SNP) in genomic region adjacent to shatterproof1 (SHELL) shell thickness gene
taatatttttgactctaatttttayagtaatttctgtttagtcaatttgg

SEQ ID NO: 5423 - DNA, 50 bp, Artificial Sequence
  synthetic Elaeis guineensis (oil palm) single nucleotide polymorphism (SNP) in genomic region adjacent to shatterproof1 (SHELL) shell thickness gene
caaccaccatgtttatctcataggmatcattgtgagaattatggagaaat

SEQ ID NO: 5424 - DNA, 50 bp, Artificial Sequence
  synthetic Elaeis guineensis (oil palm) single nucleotide polymorphism (SNP) in genomic region adjacent to shatterproof1 (SHELL) shell thickness gene
atatattttacatgtatgaaaaatrtcttcacttatcgatctattaatcc

SEQ ID NO: 5425 - DNA, 50 bp, Artificial Sequence
  synthetic Elaeis guineensis (oil palm) single nucleotide polymorphism (SNP) in genomic region adjacent to shatterproof1 (SHELL) shell thickness gene
atactagattatttgtagaaaataraaatatttattcacaacaatccgag

SEQ ID NO: 5426 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttcttttctttaatatactatattrtcttttattgcatttgaacttttat

SEQ ID NO: 5427 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatagcactaaattgggtccatctwgatttaatagggtcaaaatccattt

SEQ ID NO: 5428 - DNA, 50 bp, Artificial Sequence
  synthetic Elaeis guineensis (oil palm) single nucleotide polymorphism (SNP) in genomic region adjacent to shatterproof1 (SHELL) shell thickness gene
ataagatatttgataaaaaatttartgctttatattatgtttgccctacc

SEQ ID NO: 5429 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtgggtctactttccttctctcagygggaaaaattttggtagatcttaaa

SEQ ID NO: 5430 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttagtgatatttgcaattcaagtrggtctactttccttctctcagtggg

SEQ ID NO: 5431 - DNA, 50 bp, Artificial Sequence
  synthetic Elaeis guineensis (oil palm) single nucleotide polymorphism (SNP) in genomic region adjacent to shatterproof1 (SHELL) shell thickness gene
cttgagtgttactaacattctattkctataaacttcatttattttagtga

SEQ ID NO: 5432 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttctttaaactattataagaaagygttagagtaatagatgctcttgagt

SEQ ID NO: 5433 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatttaaaaacacttttgatcaaayattgttatattatatattttttata

SEQ ID NO: 5434 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtgtcaaccaacaattagcttctaragcacatatctaacataaaattttt

SEQ ID NO: 5435 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtataaagttttgttctgaaattayaaaatgtgtcaaccaacaattagct

SEQ ID NO: 5436 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttaatttttaagacaaatcatggayacataaatataattgaaataaaaat

SEQ ID NO: 5437 - DNA, 50 bp, Artificial Sequence
  synthetic Elaeis guineensis (oil palm) single nucleotide polymorphism (SNP) in genomic region adjacent to shatterproof1 (SHELL) shell thickness gene
aattctcaacatcttgagaatatayaaaaattatttttattaatttttaa

SEQ ID NO: 5438 - DNA, 50 bp, Artificial Sequence
  synthetic Elaeis guineensis (oil palm) single nucleotide polymorphism (SNP) in genomic region adjacent to shatterproof1 (SHELL) shell thickness gene
gattctttaattgagagcatttagraactaaccattaattaatgcatgtc

SEQ ID NO: 5439 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcactatccctatgacgattctttrattgagagcatttagaaactaacca

SEQ ID NO: 5440 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgcactctcatcccagtgtctctayaccgcagatctgagacttatctatc

SEQ ID NO: 5441 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggtcacgctcagtgcaagttgttcyctaacaaccactggcctgcactctc

SEQ ID NO: 5442 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatatatacagcaagaatccgaatkgctagagaccaagaaaacgtacagt

SEQ ID NO: 5443 - DNA, 50 bp, Artificial Sequence
  synthetic Elaeis guineensis (oil palm) single nucleotide polymorphism (SNP) in genomic region adjacent to shatterproof1 (SHELL) shell thickness gene
caaacagcaaacctgaacctactgyagtcaatatatacagcaagaatccg

SEQ ID NO: 5444 - DNA, 50 bp, Artificial Sequence
  synthetic Elaeis guineensis (oil palm) single nucleotide polymorphism (SNP) in genomic region adjacent to shatterproof1 (SHELL) shell thickness gene
ataatccatcagtgacacctagcartatgtagtgacaattcaataaaata

SEQ ID NO: 5445 - DNA, 50 bp, Artificial Sequence
  synthetic Elaeis guineensis (oil palm) single nucleotide polymorphism (SNP) in genomic region adjacent to shatterproof1 (SHELL) shell thickness gene
aataggatttcaataaattctaacmcaattacaacttcacaagtctaatt

SEQ ID NO: 5446 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctttcttgattccaaatcattatcyaatcaggctaaaaagattagatctt

SEQ ID NO: 5447 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctaagagaccatcttcttaaatagrcctttcttgattccaaatcattatc

SEQ ID NO: 5448 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttaaaattcaatcttttagaatccwaagagaccatcttcttaaataggcc

SEQ ID NO: 5449 - DNA, 50 bp, Artificial Sequence
  synthetic Elaeis guineensis (oil palm) single nucleotide polymorphism (SNP) in genomic region adjacent to shatterproof1 (SHELL) shell thickness gene
agaagaaggagaaaggatgaggcawggagatatggcaggacgagtttaga

SEQ ID NO: 5450 - DNA, 50 bp, Artificial Sequence
  synthetic Elaeis guineensis (oil palm) single nucleotide polymorphism (SNP) in genomic region adjacent to shatterproof1 (SHELL) shell thickness gene
cccttgggcataggaaagagaagarggagaaaggatgaggcaaggagata

SEQ ID NO: 5451 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctacagatatccactaagatcaaycttgaatctttctttccatggtaga

SEQ ID NO: 5452 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcatcactatcgatgatcttagatycgaaagttcttgagccgtacacgtg

SEQ ID NO: 5453 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaaataaaataaaagatgagagtraatctctatacatttatgtaggtta

SEQ ID NO: 5454 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatctaaaaataaaataaaagatgrgagtgaatctctatacatttatgta

SEQ ID NO: 5455 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttaaagtgttagaaaatcagatargatgtatgcatagatttcaaaaatt

SEQ ID NO: 5456 - DNA, 50 bp, Artificial Sequence
  synthetic Elaeis guineensis (oil palm) single nucleotide polymorphism (SNP) in genomic region adjacent to shatterproof1 (SHELL) shell thickness gene
tactaattaattactatttaatcaraaaatattatcctcataaggtacta

SEQ ID NO: 5457 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcattgtgggctgaatctcgaggcrtcaaatcctaacaatgataaatagt

SEQ ID NO: 5458 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctcattgtgggctgaatctcgaggyatcaaatcctaacaatgataaatag

SEQ ID NO: 5459 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttacatacatatttagtgattaaawattatcattgcaaaaaatctaaatc

SEQ ID NO: 5460 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcatgcaaacttcactatgaaaaaraaattttacaagaggagacctcacc

SEQ ID NO: 5461 - DNA, 50 bp, Artificial Sequence
  synthetic Elaeis guineensis (oil palm) single nucleotide polymorphism (SNP) in genomic region adjacent to shatterproof1 (SHELL) shell thickness gene
atatttatttttaaaaacttacatrcatatttagtgattaaatattatca

SEQ ID NO: 5462 - DNA, 50 bp, Artificial Sequence
  synthetic Elaeis guineensis (oil palm) single nucleotide polymorphism (SNP) in genomic region adjacent to shatterproof1 (SHELL) shell thickness gene
atcaatgtgtctagctgaaacctcrttacttttaaaatttattagatata

SEQ ID NO: 5463 - DNA, 50 bp, Artificial Sequence
  synthetic Elaeis guineensis (oil palm) single nucleotide polymorphism (SNP) in genomic region adjacent to shatterproof1 (SHELL) shell thickness gene
atatatttaacctattaaaaaaatrttaaatataaataggatatataaca

SEQ ID NO: 5464 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaagtttaaaataatatatttaacytattaaaaaaatgttaaatataaat

SEQ ID NO: 5465 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatttatctgacatgatcgaccacrtaactatttagtaaataggattggc

SEQ ID NO: 5466 - DNA, 50 bp, Artificial Sequence
  synthetic Elaeis guineensis (oil palm) single nucleotide polymorphism (SNP) in genomic region adjacent to shatterproof1 (SHELL) shell thickness gene
ataaattaattgtaatgcatcattrgtgattcagtaatcattaatgtata

SEQ ID NO: 5467 - DNA, 50 bp, Artificial Sequence
  synthetic Elaeis guineensis (oil palm) single nucleotide polymorphism (SNP) in genomic region adjacent to shatterproof1 (SHELL) shell thickness gene
agtaagtacaatatattaattatgyacccttctatattaataaattaatt

SEQ ID NO: 5468 - DNA, 50 bp, Artificial Sequence
  synthetic Elaeis guineensis (oil palm) single nucleotide polymorphism (SNP) in genomic region adjacent to shatterproof1 (SHELL) shell thickness gene
aactttaagttttcttatatttttmatacaaatcatgtaggattagtgtt

SEQ ID NO: 5469 - DNA, 50 bp, Artificial Sequence
  synthetic Elaeis guineensis (oil palm) single nucleotide polymorphism (SNP) in genomic region adjacent to shatterproof1 (SHELL) shell thickness gene
tattatattttatataaaaaacttkaagttttcttatatttttcatacaa

SEQ ID NO: 5470 - DNA, 50 bp, Artificial Sequence
  synthetic Elaeis guineensis (oil palm) single nucleotide polymorphism (SNP) in genomic region adjacent to shatterproof1 (SHELL) shell thickness gene
taatattgaatatttttaatacttyatattatattttatataaaaaactt

SEQ ID NO: 5471 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctttttaaaatataggaggtgtaaktgaaatcgaactaaaatcgaaggat

SEQ ID NO: 5472 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaggttcatttgacactttttaaartataggaggtgtaattgaaatcgaa

SEQ ID NO: 5473 - DNA, 50 bp, Artificial Sequence
  synthetic Elaeis guineensis (oil palm) single nucleotide polymorphism (SNP) in genomic region adjacent to shatterproof1 (SHELL) shell thickness gene
attaaaatagtttgttaaatagaarggttcatttgacactttttaaaata

SEQ ID NO: 5474 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatcatgtcaaggtcacatgatacmatttcattaatagaaatagatagta

SEQ ID NO: 5475 - DNA, 50 bp, Artificial Sequence
  synthetic Elaeis guineensis (oil palm) single nucleotide polymorphism (SNP) in genomic region adjacent to shatterproof1 (SHELL) shell thickness gene
acttttatatatatttatatttttwaatatgtgaaaaattttatatatac

SEQ ID NO: 5476 - DNA, 50 bp, Artificial Sequence
  synthetic Elaeis guineensis (oil palm) single nucleotide polymorphism (SNP) in genomic region adjacent to shatterproof1 (SHELL) shell thickness gene
atagaacacttttatatatatttayatttttaaatatgtgaaaaatttta

SEQ ID NO: 5477 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttaacctcattcaaacttactcgygtagccaaattaattcacaatgaat

SEQ ID NO: 5478 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttgtggttaggtccttgatgcaatrgatcttactttttaacctcattcaa

SEQ ID NO: 5479 - DNA, 50 bp, Artificial Sequence
  synthetic Elaeis guineensis (oil palm) single nucleotide polymorphism (SNP) in genomic region adjacent to shatterproof1 (SHELL) shell thickness gene
atactatatgagaaaattgtgaccyttagaagttagggtttgtggttagg

SEQ ID NO: 5480 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttgaatgctgaaaaggaatactakatgagaaaattgtgacctttagaag

SEQ ID NO: 5481 - DNA, 50 bp, Artificial Sequence
  synthetic Elaeis guineensis (oil palm) single nucleotide polymorphism (SNP) in genomic region adjacent to shatterproof1 (SHELL) shell thickness gene
aattttatatgaaatgactatcaaraaagcaattttatggtactcagcta

SEQ ID NO: 5482 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttcaatttatgaagtattgggctrttataatttgacctttataaatagt

SEQ ID NO: 5483 - DNA, 50 bp, Artificial Sequence
  synthetic Elaeis guineensis (oil palm) single nucleotide polymorphism (SNP) in genomic region adjacent to shatterproof1 (SHELL) shell thickness gene
aggtctatttagatatccgtataaygatcatggattgggacatccagata

SEQ ID NO: 5484 - DNA, 50 bp, Artificial Sequence
  synthetic Elaeis guineensis (oil palm) single nucleotide polymorphism (SNP) in genomic region adjacent to shatterproof1 (SHELL) shell thickness gene
gctatatgtcaaattttattttttytattttttatattttttaaataaga

SEQ ID NO: 5485 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctatctatataataattataaagcratatacggatattagagatgatatt

SEQ ID NO: 5486 - DNA, 50 bp, Artificial Sequence
  synthetic Elaeis guineensis (oil palm) single nucleotide polymorphism (SNP) in genomic region adjacent to shatterproof1 (SHELL) shell thickness gene
tacgtaaaacatctcctccctttgraatggaaattgatgcatggacaatg

SEQ ID NO: 5487 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaattagttgggcaaggaaggatgwcttgtacataaatatttccaagaaa

SEQ ID NO: 5488 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccctggtggcttcttccaatccgtrccctatgcttccaccatggccaccc

SEQ ID NO: 5489 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcgtaaaggttttcctttttccttrctgcctttacgagtgggactatgat

SEQ ID NO: 5490 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgtgtataattagctgaacatcaamtactagtcaaaaaaaaaaaagcagc

SEQ ID NO: 5491 - DNA, 50 bp, Artificial Sequence
  synthetic Elaeis guineensis (oil palm) single nucleotide polymorphism (SNP) in genomic region adjacent to shatterproof1 (SHELL) shell thickness gene
agttcttagccttgtacatacttaytcacaacttgtaccaaagacaccaa

SEQ ID NO: 5492 - DNA, 50 bp, Artificial Sequence
  synthetic Elaeis guineensis (oil palm) single nucleotide polymorphism (SNP) in genomic region adjacent to shatterproof1 (SHELL) shell thickness gene
atcagggcttagtcaaaaattttawgtgggatttctaaagcctaaaactg

SEQ ID NO: 5493 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatttcctccggttgttagtcacarattgacagatgcctcatttattgcc

SEQ ID NO: 5494 - DNA, 50 bp, Artificial Sequence
  synthetic Elaeis guineensis (oil palm) single nucleotide polymorphism (SNP) in genomic region adjacent to shatterproof1 (SHELL) shell thickness gene
atcaacagttgaaaatttttccgtkaatcttcccttattatgtatttctg

SEQ ID NO: 5495 - DNA, 50 bp, Artificial Sequence
  synthetic Elaeis guineensis (oil palm) single nucleotide polymorphism (SNP) in genomic region adjacent to shatterproof1 (SHELL) shell thickness gene
catggaacgtggtcaaactagcatrcagaacttcggacattctggtgctg

SEQ ID NO: 5496 - DNA, 50 bp, Artificial Sequence
  synthetic Elaeis guineensis (oil palm) single nucleotide polymorphism (SNP) in genomic region adjacent to shatterproof1 (SHELL) shell thickness gene
atgacattagttaggttgtggcttytcttgcaaaacagcaaacgtgacat

SEQ ID NO: 5497 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcccgaaccgtctttctttcaaagwctccaatcctctctctctcctcttc

SEQ ID NO: 5498 - DNA, 50 bp, Artificial Sequence
  synthetic Elaeis guineensis (oil palm) single nucleotide polymorphism (SNP) in genomic region adjacent to shatterproof1 (SHELL) shell thickness gene
tccctcccctgacgacgtgtccctrtcaggcgacgtggtgctccacggag

SEQ ID NO: 5499 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttttttttttggtagaagtttggawaacttatttaaaagaagaaagtcat

SEQ ID NO: 5500 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaaaagattaattctttactatagytgtctttaagaaaacagaaaacaca

SEQ ID NO: 5501 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtccacctaatagtaatttattctwccatacataattaatctagttcacc

SEQ ID NO: 5502 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaattgataagtccacctaatagtwatttattctaccatacataattaat

SEQ ID NO: 5503 - DNA, 50 bp, Artificial Sequence
  synthetic Elaeis guineensis (oil palm) single nucleotide polymorphism (SNP) in genomic region adjacent to shatterproof1 (SHELL) shell thickness gene
tagattctcatctagaaaatgttgwgctttatatcaacgtcatgaaatat

SEQ ID NO: 5504 - DNA, 50 bp, Artificial Sequence
  synthetic Elaeis guineensis (oil palm) single nucleotide polymorphism (SNP) in genomic region adjacent to shatterproof1 (SHELL) shell thickness gene
acgtgcgcctcatggctctatccawgactttaataggaaagaaggctctg

SEQ ID NO: 5505 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctcccacaagtgcccaaaaatggasttattggttgttttatttgttggca

SEQ ID NO: 5506 - DNA, 50 bp, Artificial Sequence
  synthetic Elaeis guineensis (oil palm) single nucleotide polymorphism (SNP) in genomic region adjacent to shatterproof1 (SHELL) shell thickness gene
agctgaagtcttagattattgctcygagaggtgtagtgatggaaccgaaa

SEQ ID NO: 5507 - DNA, 50 bp, Artificial Sequence
  synthetic Elaeis guineensis (oil palm) single nucleotide polymorphism (SNP) in genomic region adjacent to shatterproof1 (SHELL) shell thickness gene
atagaaagagttaaatgatagggayatattgaaatatcaacaatgctttt

SEQ ID NO: 5508 - DNA, 50 bp, Artificial Sequence
  synthetic Elaeis guineensis (oil palm) single nucleotide polymorphism (SNP) in genomic region adjacent to shatterproof1 (SHELL) shell thickness gene
catatgtatagaaagagttaaatgrtagggacatattgaaatatcaacaa

SEQ ID NO: 5509 - DNA, 50 bp, Artificial Sequence
  synthetic Elaeis guineensis (oil palm) single nucleotide polymorphism (SNP) in genomic region adjacent to shatterproof1 (SHELL) shell thickness gene
cttccttgaaattagctttattatratggtaactaatatttctgaaatat

SEQ ID NO: 5510 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcctatgaacatgcctataacaccmtgccatttctaaaaagggaaaaaga

SEQ ID NO: 5511 - DNA, 50 bp, Artificial Sequence
  synthetic Elaeis guineensis (oil palm) single nucleotide polymorphism (SNP) in genomic region adjacent to shatterproof1 (SHELL) shell thickness gene
atcttgaaattatatgacatcgttytggtgctcctatgaacatgcctata

SEQ ID NO: 5512 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctcatagactataaaccagtgtargattatatatgataatccgggccaa

SEQ ID NO: 5513 - DNA, 50 bp, Artificial Sequence
  synthetic Elaeis guineensis (oil palm) single nucleotide polymorphism (SNP) in genomic region adjacent to shatterproof1 (SHELL) shell thickness gene
aacattttagcatgcggtccatcarccatgatttttttaatttttgatct

SEQ ID NO: 5514 - DNA, 50 bp, Artificial Sequence
  synthetic Elaeis guineensis (oil palm) single nucleotide polymorphism (SNP) in genomic region adjacent to shatterproof1 (SHELL) shell thickness gene
caaaaatgagtgaaatacataggartagtatggagtataattcataaaaa

SEQ ID NO: 5515 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttgtgttcctttgagccatcgtcrtgagaaaatattcacagcaacggtg

SEQ ID NO: 5516 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggctgccaaatgctggaaagacttwaagacccttttacataaaagtttta

SEQ ID NO: 5517 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttcatctttttcacaagaaagatayaggtatgattacaacctttataaat

SEQ ID NO: 5518 - DNA, 50 bp, Artificial Sequence
  synthetic Elaeis guineensis (oil palm) single nucleotide polymorphism (SNP) in genomic region adjacent to shatterproof1 (SHELL) shell thickness gene
attaatgatataacaaactactcakggataataattctcaaaagaaaata

SEQ ID NO: 5519 - DNA, 50 bp, Artificial Sequence
  synthetic Elaeis guineensis (oil palm) single nucleotide polymorphism (SNP) in genomic region adjacent to shatterproof1 (SHELL) shell thickness gene
tattaactagtataaataaataatraaaaaattaaaattttacgagagat

SEQ ID NO: 5520 - DNA, 50 bp, Artificial Sequence
  synthetic Elaeis guineensis (oil palm) single nucleotide polymorphism (SNP) in genomic region adjacent to shatterproof1 (SHELL) shell thickness gene
gatgatttaaaaataaggtatataycacttatttataatcgcaagatcgc

SEQ ID NO: 5521 - DNA, 50 bp, Artificial Sequence
  synthetic Elaeis guineensis (oil palm) single nucleotide polymorphism (SNP) in genomic region adjacent to shatterproof1 (SHELL) shell thickness gene
cattaaaaattatagcaagcatgcwtcttgacggttacacacctctatct

SEQ ID NO: 5522 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttcatgacaagccattaaaaattayagcaagcatgcttcttgacggttac

SEQ ID NO: 5523 - DNA, 50 bp, Artificial Sequence
  synthetic Elaeis guineensis (oil palm) single nucleotide polymorphism (SNP) in genomic region adjacent to shatterproof1 (SHELL) shell thickness gene
cgatgtgatgaccatttctgatggrcacttgatggggtcattaacttcaa

SEQ ID NO: 5524 - DNA, 50 bp, Artificial Sequence
  synthetic Elaeis guineensis (oil palm) single nucleotide polymorphism (SNP) in genomic region adjacent to shatterproof1 (SHELL) shell thickness gene
agaaattcttggcaatcctaagtckttgaacaagtagtcacatttgtttt

SEQ ID NO: 5525 - DNA, 50 bp, Artificial Sequence
  synthetic Elaeis guineensis (oil palm) single nucleotide polymorphism (SNP) in genomic region adjacent to shatterproof1 (SHELL) shell thickness gene
atatctttggccaaatggataggtyaggccatgaactaaaattaacaggc

SEQ ID NO: 5526 - DNA, 50 bp, Artificial Sequence
  synthetic Elaeis guineensis (oil palm) single nucleotide polymorphism (SNP) in genomic region adjacent to shatterproof1 (SHELL) shell thickness gene
aattagagagtcagaattagagagycgactttctttgagaggcagtccaa

SEQ ID NO: 5527 - DNA, 50 bp, Artificial Sequence
  synthetic Elaeis guineensis (oil palm) single nucleotide polymorphism (SNP) in genomic region adjacent to shatterproof1 (SHELL) shell thickness gene
catccaatcagaattagagagtcaraattagagagccgactttctttgag

SEQ ID NO: 5528 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttataagtggcatccaatcagaawtagagagtcagaattagagagccga

SEQ ID NO: 5529 - DNA, 50 bp, Artificial Sequence
  synthetic Elaeis guineensis (oil palm) single nucleotide polymorphism (SNP) in genomic region adjacent to shatterproof1 (SHELL) shell thickness gene
taggagtaatttaagaattaataaraattattaattcttaggatgatttt

SEQ ID NO: 5530 - DNA, 50 bp, Artificial Sequence
  synthetic Elaeis guineensis (oil palm) single nucleotide polymorphism (SNP) in genomic region adjacent to shatterproof1 (SHELL) shell thickness gene
cacttgcactctcgctcattattcycacactgtagactaaaaactcgtct

SEQ ID NO: 5531 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccacttgcactctcgctcattattyccacactgtagactaaaaactcgtc

SEQ ID NO: 5532 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgatcgctcatttgatcacactcartaccgatgttctctaacaaccactt

SEQ ID NO: 5533 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaactactcacaccactacagcatygagacgatcattgacgagtgagaaa

SEQ ID NO: 5534 - DNA, 50 bp, Artificial Sequence
  synthetic Elaeis guineensis (oil palm) single nucleotide polymorphism (SNP) in genomic region adjacent to shatterproof1 (SHELL) shell thickness gene
caaaaaactactcacaccactacarcattgagacgatcattgacgagtga

SEQ ID NO: 5535 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttgctatggccacaaacttaaggayccagcctctcaaatttcatagtact

SEQ ID NO: 5536 - DNA, 50 bp, Artificial Sequence
  synthetic Elaeis guineensis (oil palm) single nucleotide polymorphism (SNP) in genomic region adjacent to shatterproof1 (SHELL) shell thickness gene
atttagtttctctatcatgtgtccygataggatggaggttatgaaaactc

SEQ ID NO: 5537 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttggattgcaacatttataattagrtcctcctagctaacaattagctgat

SEQ ID NO: 5538 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttcaatctcaatccaattcgaatcraattcgagtccaacctgatccagac

SEQ ID NO: 5539 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggtttgggttcaatctcaatccaaktcgaatcgaattcgagtccaacctg

SEQ ID NO: 5540 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctctagggtgatcgaccaggaggrggtggggcatgtggattagggtgga

SEQ ID NO: 5541 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctccctttctttctttatttttckcgctgatctctctctttccttctct

SEQ ID NO: 5542 - DNA, 50 bp, Artificial Sequence
  synthetic Elaeis guineensis (oil palm) single nucleotide polymorphism (SNP) in genomic region adjacent to shatterproof1 (SHELL) shell thickness gene
aggtactagctctcttgtagatctyactccttcaagtttagatctaatct

SEQ ID NO: 5543 - DNA, 50 bp, Artificial Sequence
  synthetic Elaeis guineensis (oil palm) single nucleotide polymorphism (SNP) in genomic region adjacent to shatterproof1 (SHELL) shell thickness gene
aggctaaagtagatcaaagcatccragatccccgaggtactagctctctt

SEQ ID NO: 5544 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaaaaataaaatgaaagtatgcatmtaattttaaaataaaataatcaaaa

SEQ ID NO: 5545 - DNA, 50 bp, Artificial Sequence
  synthetic Elaeis guineensis (oil palm) single nucleotide polymorphism (SNP) in genomic region adjacent to shatterproof1 (SHELL) shell thickness gene
catatgaacccgtgactctgatacyactattgaattttgaggtgtcatgc

SEQ ID NO: 5546 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttatgccaagacaatcttatagcayatcgatatcgaactaattaacatat

SEQ ID NO: 5547 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaatatatcataaatctcatacatrattgtagattaaatctaaaatcgtt

SEQ ID NO: 5548 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcgacttgattaactacaactattrttttaatcctgagaactcttgatct

SEQ ID NO: 5549 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttaacatatagatatcaatcgactygattaactacaactattattttaat

SEQ ID NO: 5550 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttgggtcaatcgagttaacatatrgatatcaatcgacttgattaactac

SEQ ID NO: 5551 - DNA, 50 bp, Artificial Sequence
  synthetic Elaeis guineensis (oil palm) single nucleotide polymorphism (SNP) in genomic region adjacent to shatterproof1 (SHELL) shell thickness gene
cttacaatatttagtgcctctagcrtcttaaattaaatattcatcaccac

SEQ ID NO: 5552 - DNA, 50 bp, Artificial Sequence
  synthetic Elaeis guineensis (oil palm) single nucleotide polymorphism (SNP) in genomic region adjacent to shatterproof1 (SHELL) shell thickness gene
taataaaataatattaatgattacktacaatatttagtgcctctagcatc

SEQ ID NO: 5553 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaatagactagatagcattaaattyttaataaaataatattaatgattac

SEQ ID NO: 5554 - DNA, 50 bp, Artificial Sequence
  synthetic Elaeis guineensis (oil palm) single nucleotide polymorphism (SNP) in genomic region adjacent to shatterproof1 (SHELL) shell thickness gene
actctcgattacctgtaaaatagaytagatagcattaaatttttaataaa

SEQ ID NO: 5555 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttcacactgaaataagagctgattrcttggttcactcaaatctgaaccaa

SEQ ID NO: 5556 - DNA, 50 bp, Artificial Sequence
  synthetic Elaeis guineensis (oil palm) single nucleotide polymorphism (SNP) in genomic region adjacent to shatterproof1 (SHELL) shell thickness gene
cttgctgcgcccgatggtggatgtrtctccttgaatccttcatttttctc

SEQ ID NO: 5557 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaccaagttgatcttcttgctgcgyccgatggtggatgtgtctccttgaa

SEQ ID NO: 5558 - DNA, 50 bp, Artificial Sequence
  synthetic Elaeis guineensis (oil palm) single nucleotide polymorphism (SNP) in genomic region adjacent to shatterproof1 (SHELL) shell thickness gene
cttttcattaatcttataaagaagyatacataaaaaaaaaaaattacgat

SEQ ID NO: 5559 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatagtaaattattctaatctataraaagtagtaaattgctaggttatag

SEQ ID NO: 5560 - DNA, 50 bp, Artificial Sequence
  synthetic Elaeis guineensis (oil palm) single nucleotide polymorphism (SNP) in genomic region adjacent to shatterproof1 (SHELL) shell thickness gene
atctatttatgaagtagaaaatctytaattatataaaaatagtaaattat

SEQ ID NO: 5561 - DNA, 50 bp, Artificial Sequence
  synthetic Elaeis guineensis (oil palm) single nucleotide polymorphism (SNP) in genomic region adjacent to shatterproof1 (SHELL) shell thickness gene
acagttaagaataaaaggtaactaygtaatccaaataaaaggctaagaat

SEQ ID NO: 5562 - DNA, 50 bp, Artificial Sequence
  synthetic Elaeis guineensis (oil palm) single nucleotide polymorphism (SNP) in genomic region adjacent to shatterproof1 (SHELL) shell thickness gene
taactacttaactatgcaaataagrtaatctcacagttaagaataaaagg

SEQ ID NO: 5563 - DNA, 50 bp, Artificial Sequence
  synthetic Elaeis guineensis (oil palm) single nucleotide polymorphism (SNP) in genomic region adjacent to shatterproof1 (SHELL) shell thickness gene
atagtaaatcactaagaataatagrcaataataaataagataactactta

SEQ ID NO: 5564 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttttaggataataaattattctaarctatagaaaatagtaaatcactaag

SEQ ID NO: 5565 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagatcaagtgattctaactaaatraaaagtaaatcatactaagattaaa

SEQ ID NO: 5566 - DNA, 50 bp, Artificial Sequence
  synthetic Elaeis guineensis (oil palm) single nucleotide polymorphism (SNP) in genomic region adjacent to shatterproof1 (SHELL) shell thickness gene
attagatattagaagatcaagtgawtctaactaaataaaaagtaaatcat

SEQ ID NO: 5567 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttaagtagattttaaaatttaattratttatttatattagtcaagtgtta

SEQ ID NO: 5568 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctgaagatttatcatcattcttgrtcttcaggctctccaggtatgtaca

SEQ ID NO: 5569 - DNA, 50 bp, Artificial Sequence
  synthetic Elaeis guineensis (oil palm) single nucleotide polymorphism (SNP) in genomic region adjacent to shatterproof1 (SHELL) shell thickness gene
tggcccttttgccatatcccacaawacatagcttggtcattttttcttaa

SEQ ID NO: 5570 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttttctttgagataactcaaaaaarttttactaaaatattctcctcttca

SEQ ID NO: 5571 - DNA, 50 bp, Artificial Sequence
  synthetic Elaeis guineensis (oil palm) single nucleotide polymorphism (SNP) in genomic region adjacent to shatterproof1 (SHELL) shell thickness gene
agaaggagtccattataagactatrtcattttctttgagataactcaaaa

SEQ ID NO: 5572 - DNA, 50 bp, Artificial Sequence
  synthetic Elaeis guineensis (oil palm) single nucleotide polymorphism (SNP) in genomic region adjacent to shatterproof1 (SHELL) shell thickness gene
agaatcttatttagtaaataaatcrtggttagtagagcataaccctaaag

SEQ ID NO: 5573 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtagaaatagatttagagagaatcytatttagtaaataaatcatggttag

SEQ ID NO: 5574 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatctcatatgatatagtagaaatrgatttagagagaatcttatttagta

SEQ ID NO: 5575 - DNA, 50 bp, Artificial Sequence
  synthetic Elaeis guineensis (oil palm) single nucleotide polymorphism (SNP) in genomic region adjacent to shatterproof1 (SHELL) shell thickness gene
tagcctctaacttgtcagccatttrtcttttcacataggctggacatctc

SEQ ID NO: 5576 - DNA, 50 bp, Artificial Sequence
  synthetic Elaeis guineensis (oil palm) single nucleotide polymorphism (SNP) in genomic region adjacent to shatterproof1 (SHELL) shell thickness gene
tggacctagcctctaacttgtcagycatttgtcttttcacataggctgga

SEQ ID NO: 5577 - DNA, 50 bp, Artificial Sequence
  synthetic Elaeis guineensis (oil palm) single nucleotide polymorphism (SNP) in genomic region adjacent to shatterproof1 (SHELL) shell thickness gene
agcaaaagtagtatcatattgattytttaggataccttatgaagcaagct

SEQ ID NO: 5578 - DNA, 50 bp, Artificial Sequence
  synthetic Elaeis guineensis (oil palm) single nucleotide polymorphism (SNP) in genomic region adjacent to shatterproof1 (SHELL) shell thickness gene
cgtgtcgactcacaattacattatratcgtctgaaaagcaaaagtagtat

SEQ ID NO: 5579 - DNA, 50 bp, Artificial Sequence
  synthetic Elaeis guineensis (oil palm) single nucleotide polymorphism (SNP) in genomic region adjacent to shatterproof1 (SHELL) shell thickness gene
atttttctagaaacatagcgtgtcractcacaattacattatgatcgtct

SEQ ID NO: 5580 - DNA, 50 bp, Artificial Sequence
  synthetic Elaeis guineensis (oil palm) single nucleotide polymorphism (SNP) in genomic region adjacent to shatterproof1 (SHELL) shell thickness gene
taaattatttttctagaaacatagygtgtcgactcacaattacattatga

SEQ ID NO: 5581 - DNA, 50 bp, Artificial Sequence
  synthetic Elaeis guineensis (oil palm) single nucleotide polymorphism (SNP) in genomic region adjacent to shatterproof1 (SHELL) shell thickness gene
tagatcctctgtaagcatacctaartacctttcaagaggacaggagatcc

SEQ ID NO: 5582 - DNA, 50 bp, Artificial Sequence
  synthetic Elaeis guineensis (oil palm) single nucleotide polymorphism (SNP) in genomic region adjacent to shatterproof1 (SHELL) shell thickness gene
atgatccttatctcctacgaagaayatttcttctagatcctctgtaagca

SEQ ID NO: 5583 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcttttcttgtagtgtctccatgayccttatctcctacgaagaatatttc

SEQ ID NO: 5584 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttatgatgaaaaataatttttatcrtaaataatttattattagcaataaa

SEQ ID NO: 5585 - DNA, 50 bp, Artificial Sequence
  synthetic Elaeis guineensis (oil palm) single nucleotide polymorphism (SNP) in genomic region adjacent to shatterproof1 (SHELL) shell thickness gene
attaacttttcatcataaatacttytattatttatgatgaaactattttc

SEQ ID NO: 5586 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatgtcaaaaatttaattattatcrtcaatactcattatttatgatgtaa

SEQ ID NO: 5587 - DNA, 50 bp, Artificial Sequence
  synthetic Elaeis guineensis (oil palm) single nucleotide polymorphism (SNP) in genomic region adjacent to shatterproof1 (SHELL) shell thickness gene
atttatgtcaaaaatttaattattrtcatcaatactcattatttatgatg

SEQ ID NO: 5588 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcatcgctaatactccattatttaygacgtaatatttttatcacaaataa

SEQ ID NO: 5589 - DNA, 50 bp, Artificial Sequence
  synthetic Elaeis guineensis (oil palm) single nucleotide polymorphism (SNP) in genomic region adjacent to shatterproof1 (SHELL) shell thickness gene
caatgaaaattgatgtttcatcgcyaatactccattatttacgacgtaat

SEQ ID NO: 5590 - DNA, 50 bp, Artificial Sequence
  synthetic Elaeis guineensis (oil palm) single nucleotide polymorphism (SNP) in genomic region adjacent to shatterproof1 (SHELL) shell thickness gene
attgacaatgaaaattgatgtttcrtcgctaatactccattatttacgac

SEQ ID NO: 5591 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatgcacatattattttttaaaaaytatctaatatttatttttataaata

SEQ ID NO: 5592 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttgtctaggattgatttttgatttycataatattttggatccaaccattc

SEQ ID NO: 5593 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggcctattttactattgtctaggaytgatttttgattttcataatatttt

SEQ ID NO: 5594 - DNA, 50 bp, Artificial Sequence
  synthetic Elaeis guineensis (oil palm) single nucleotide polymorphism (SNP) in genomic region adjacent to shatterproof1 (SHELL) shell thickness gene
gacaaggaaccagatcatcagtttsggattttttaaattaaaattttgat

SEQ ID NO: 5595 - DNA, 50 bp, Artificial Sequence
  synthetic Elaeis guineensis (oil palm) single nucleotide polymorphism (SNP) in genomic region adjacent to shatterproof1 (SHELL) shell thickness gene
atgtaagtatttttctaggcttcgraaccatgaattagacaaggaaccag

SEQ ID NO: 5596 - DNA, 50 bp, Artificial Sequence
  synthetic Elaeis guineensis (oil palm) single nucleotide polymorphism (SNP) in genomic region adjacent to shatterproof1 (SHELL) shell thickness gene
cttgctgttcaagaatgtcggcaayagaaggtaattcttagacgttgttg

SEQ ID NO: 5597 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagatggagatggatagaataaagyaattataaatataaaactctttttc

SEQ ID NO: 5598 - DNA, 50 bp, Artificial Sequence
  synthetic Elaeis guineensis (oil palm) single nucleotide polymorphism (SNP) in genomic region adjacent to shatterproof1 (SHELL) shell thickness gene
tacgaagatatttaaaagtttcaaraaataatattaaagcatacagcttg

SEQ ID NO: 5599 - DNA, 50 bp, Artificial Sequence
  synthetic Elaeis guineensis (oil palm) single nucleotide polymorphism (SNP) in genomic region adjacent to shatterproof1 (SHELL) shell thickness gene
gatacgaagatatttaaaagtttcraaaaataatattaaagcatacagct

SEQ ID NO: 5600 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttaccttatcagcggacgcgactgygatggcgacggtgatcgaggatggc

SEQ ID NO: 5601 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcggttcacgattttagtatgaagyaattttatcaaaaattttaacttga

SEQ ID NO: 5602 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctttataaaataatatacagtcatytttgcaggcatgtataagaatatag

SEQ ID NO: 5603 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttatcaaatttcggacattcagttrcttattcattatctttataaaataa

SEQ ID NO: 5604 - DNA, 50 bp, Artificial Sequence
  synthetic Elaeis guineensis (oil palm) single nucleotide polymorphism (SNP) in genomic region adjacent to shatterproof1 (SHELL) shell thickness gene
taatgtcatctcattttttcagctrtctttatggacatatataacctttg

SEQ ID NO: 5605 - DNA, 50 bp, Artificial Sequence
  synthetic Elaeis guineensis (oil palm) single nucleotide polymorphism (SNP) in genomic region adjacent to shatterproof1 (SHELL) shell thickness gene
gatggctaagtatattctcctcagraagtcactactcataatgtcatctc

SEQ ID NO: 5606 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctttccatactaaagagtcgaccrgatggctaagtatattctcctcagg

SEQ ID NO: 5607 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaccaagtcagatattgtggggatyactcgcaaagtatgaatgctttgca

SEQ ID NO: 5608 - DNA, 50 bp, Artificial Sequence
  synthetic Elaeis guineensis (oil palm) single nucleotide polymorphism (SNP) in genomic region adjacent to shatterproof1 (SHELL) shell thickness gene
aggtgacacattatatacaactagyatcacaggccacatattataaaagg

SEQ ID NO: 5609 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttcattacctggtgctttcggatcyggaatcaactgtgacataaaaataa

SEQ ID NO: 5610 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatacatcaatttcattacctggtrctttcggatccggaatcaactgtga

SEQ ID NO: 5611 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatatacatcaatttcattacctgrtgctttcggatccggaatcaactgt

SEQ ID NO: 5612 - DNA, 50 bp, Artificial Sequence
  synthetic Elaeis guineensis (oil palm) single nucleotide polymorphism (SNP) in genomic region adjacent to shatterproof1 (SHELL) shell thickness gene
gttgtatatatacatcaatttcatwacctggtgctttcggatccggaatc

SEQ ID NO: 5613 - DNA, 50 bp, Artificial Sequence
  synthetic Elaeis guineensis (oil palm) single nucleotide polymorphism (SNP) in genomic region adjacent to shatterproof1 (SHELL) shell thickness gene
gacctatgaaatatattttctgtcygtgctttaaatataaagaggatgca

SEQ ID NO: 5614 - DNA, 50 bp, Artificial Sequence
  synthetic Elaeis guineensis (oil palm) single nucleotide polymorphism (SNP) in genomic region adjacent to shatterproof1 (SHELL) shell thickness gene
tccttaggtggcgaacatcggtcgracttaccatcaaaatattggttata

SEQ ID NO: 5615 - DNA, 50 bp, Artificial Sequence
  synthetic Elaeis guineensis (oil palm) single nucleotide polymorphism (SNP) in genomic region adjacent to shatterproof1 (SHELL) shell thickness gene
attagacattttcaatgacttcaarttgttctaaaatttttgctccattt

SEQ ID NO: 5616 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttgtccaattcagctcagcttcartatgcttccacttgcgagtacccga

SEQ ID NO: 5617 - DNA, 50 bp, Artificial Sequence
  synthetic Elaeis guineensis (oil palm) single nucleotide polymorphism (SNP) in genomic region adjacent to shatterproof1 (SHELL) shell thickness gene
tagttcgaaaaagatgcttcacttygtccaattcagctcagcttcagtat

SEQ ID NO: 5618 - DNA, 50 bp, Artificial Sequence
  synthetic Elaeis guineensis (oil palm) single nucleotide polymorphism (SNP) in genomic region adjacent to shatterproof1 (SHELL) shell thickness gene
accgatgatattatcataaatattyttttcaatgtgtattacatcgagat

SEQ ID NO: 5619 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttttctagatgttcaatacagtaycgatgatattatcataaatattttt

SEQ ID NO: 5620 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcaacttcgatcggattctcatttyctgcaaatcaagatgagcttttgta

SEQ ID NO: 5621 - DNA, 50 bp, Artificial Sequence
  synthetic Elaeis guineensis (oil palm) single nucleotide polymorphism (SNP) in genomic region adjacent to shatterproof1 (SHELL) shell thickness gene
gattttaaaccatccacagaaattyttcttttcctcaccaaacagtgaat

SEQ ID NO: 5622 - DNA, 50 bp, Artificial Sequence
  synthetic Elaeis guineensis (oil palm) single nucleotide polymorphism (SNP) in genomic region adjacent to shatterproof1 (SHELL) shell thickness gene
taatttttgacaacacagttctcgraagaacactcccagctcaatcaatg

SEQ ID NO: 5623 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttctaacttacaaagaatgagtacratatccttctctaatttttcaagta

SEQ ID NO: 5624 - DNA, 50 bp, Artificial Sequence
  synthetic Elaeis guineensis (oil palm) single nucleotide polymorphism (SNP) in genomic region adjacent to shatterproof1 (SHELL) shell thickness gene
atccaacgataatgtaccggtccgrccaaaagtgctttctttggaagata

SEQ ID NO: 5625 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggatacatccaacgataatgtaccrgtccgaccaaaagtgctttctttgg

SEQ ID NO: 5626 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggcacggtctgtctcgtccgattcwccgtatttttggcacatcatctctg

SEQ ID NO: 5627 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaattaaaaattacctaccatgtrctccatgtgacgagcgaacgatctc

SEQ ID NO: 5628 - DNA, 50 bp, Artificial Sequence
  synthetic Elaeis guineensis (oil palm) single nucleotide polymorphism (SNP) in genomic region adjacent to shatterproof1 (SHELL) shell thickness gene
caatttgagaattaattaaaaaaawtttaaataactaaaaattatatgct

SEQ ID NO: 5629 - DNA, 50 bp, Artificial Sequence
  synthetic Elaeis guineensis (oil palm) single nucleotide polymorphism (SNP) in genomic region adjacent to shatterproof1 (SHELL) shell thickness gene
cagaaatagactgagatctcatgtytgtcttacgatcttaaaaattaaaa

SEQ ID NO: 5630 - DNA, 50 bp, Artificial Sequence
  synthetic Elaeis guineensis (oil palm) single nucleotide polymorphism (SNP) in genomic region adjacent to shatterproof1 (SHELL) shell thickness gene
catctggatctgaagctgctgatayttatcgacgcgtgcagccaactcct

SEQ ID NO: 5631 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctatccactctatcatctggatctraagctgctgatatttatcgacgcgt

SEQ ID NO: 5632 - DNA, 50 bp, Artificial Sequence
  synthetic Elaeis guineensis (oil palm) single nucleotide polymorphism (SNP) in genomic region adjacent to shatterproof1 (SHELL) shell thickness gene
gacatctagagaacgagctggagayggagagcacttgacggagctcgaac

SEQ ID NO: 5633 - DNA, 50 bp, Artificial Sequence
  synthetic Elaeis guineensis (oil palm) single nucleotide polymorphism (SNP) in genomic region adjacent to shatterproof1 (SHELL) shell thickness gene
atattaaattaaaattataaaaaawttaaaataaaaaatatatcaataag

SEQ ID NO: 5634 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatatatttattaaaaaattaaatyatgttagtaaaatatatttgacgat

SEQ ID NO: 5635 - DNA, 50 bp, Artificial Sequence
  synthetic Elaeis guineensis (oil palm) single nucleotide polymorphism (SNP) in genomic region adjacent to shatterproof1 (SHELL) shell thickness gene
tagcgatgaaaatattttcatcgcyattaattctaaagttttagcgacta

SEQ ID NO: 5636 - DNA, 50 bp, Artificial Sequence
  synthetic Elaeis guineensis (oil palm) single nucleotide polymorphism (SNP) in genomic region adjacent to shatterproof1 (SHELL) shell thickness gene
atatttatgatgaattataccatcrctaataaataaaaaattaatagcga

SEQ ID NO: 5637 - DNA, 50 bp, Artificial Sequence
  synthetic Elaeis guineensis (oil palm) single nucleotide polymorphism (SNP) in genomic region adjacent to shatterproof1 (SHELL) shell thickness gene
cataattttcgtcactaatatttcrtcaccaataatcgcatcgttgataa

SEQ ID NO: 5638 - DNA, 50 bp, Artificial Sequence
  synthetic Elaeis guineensis (oil palm) single nucleotide polymorphism (SNP) in genomic region adjacent to shatterproof1 (SHELL) shell thickness gene
tacaacaaaataggttattagcgaygaaaaattttcatcgctaataatcg

SEQ ID NO: 5639 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttcacctcgagcctagctttatagrtctctactttaccatctatacctat

SEQ ID NO: 5640 - DNA, 50 bp, Artificial Sequence
  synthetic Elaeis guineensis (oil palm) single nucleotide polymorphism (SNP) in genomic region adjacent to shatterproof1 (SHELL) shell thickness gene
gatctccatcactagatgtgaaatycttaggctattccatatagaaatct

SEQ ID NO: 5641 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctatatataaatctttacagcttgyagactttatgatctccatcactaga

SEQ ID NO: 5642 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaagcttgttttaatctatatataratctttacagcttgcagactttatg

SEQ ID NO: 5643 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcgttgaaatgaatattctaacttygagaagcttgttttaatctatatat

SEQ ID NO: 5644 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgtcatccacgtacagtacgaagamtgtgacagcactcccactgatcttc

SEQ ID NO: 5645 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaaatgtaattcccaataaggagratgtcatccacgtacagtacgaaga

SEQ ID NO: 5646 - DNA, 50 bp, Artificial Sequence
  synthetic Elaeis guineensis (oil palm) single nucleotide polymorphism (SNP) in genomic region adjacent to shatterproof1 (SHELL) shell thickness gene
caatcatcttttgatcaaaaatgtmattcccaataaggaggatgtcatcc

SEQ ID NO: 5647 - DNA, 50 bp, Artificial Sequence
  synthetic Elaeis guineensis (oil palm) single nucleotide polymorphism (SNP) in genomic region adjacent to shatterproof1 (SHELL) shell thickness gene
acttcccctatgtacattttctatraaaaaccaagcatccttttggatct

SEQ ID NO: 5648 - DNA, 50 bp, Artificial Sequence
  synthetic Elaeis guineensis (oil palm) single nucleotide polymorphism (SNP) in genomic region adjacent to shatterproof1 (SHELL) shell thickness gene
atccagtactcttcgtccagattcractaataactgctcatgacactcac

SEQ ID NO: 5649 - DNA, 50 bp, Artificial Sequence
  synthetic Elaeis guineensis (oil palm) single nucleotide polymorphism (SNP) in genomic region adjacent to shatterproof1 (SHELL) shell thickness gene
cacagctatccagtactcttcgtcyagattcgactaataactgctcatga

SEQ ID NO: 5650 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctgaattaatatatccttcgaaccrcagctctgatcctccgtcaaagatt

SEQ ID NO: 5651 - DNA, 50 bp, Artificial Sequence
  synthetic Elaeis guineensis (oil palm) single nucleotide polymorphism (SNP) in genomic region adjacent to shatterproof1 (SHELL) shell thickness gene
caccattgcatacaaacacacaatytgatatagatcttctatcatcaaaa

SEQ ID NO: 5652 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttggaactcttccacctggtagctycaccattgcatacaaacacacaatt

SEQ ID NO: 5653 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatcattacactaagttctgcgatraattttttataccagaaagcttcct

SEQ ID NO: 5654 - DNA, 50 bp, Artificial Sequence
  synthetic Elaeis guineensis (oil palm) single nucleotide polymorphism (SNP) in genomic region adjacent to shatterproof1 (SHELL) shell thickness gene
taaagtaatggcatccaatatcatkacactaagttctgcgatgaattttt

SEQ ID NO: 5655 - DNA, 50 bp, Artificial Sequence
  synthetic Elaeis guineensis (oil palm) single nucleotide polymorphism (SNP) in genomic region adjacent to shatterproof1 (SHELL) shell thickness gene
agtgctatggtgtcattgttgtcgyagtataaagtaatggcatccaatat

SEQ ID NO: 5656 - DNA, 50 bp, Artificial Sequence
  synthetic Elaeis guineensis (oil palm) single nucleotide polymorphism (SNP) in genomic region adjacent to shatterproof1 (SHELL) shell thickness gene
tagactctttagtgagtgctatggygtcattgttgtcgtagtataaagta

SEQ ID NO: 5657 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttgtatatgactccataggttctrttctgtctggtagtgagatattgtc

SEQ ID NO: 5658 - DNA, 50 bp, Artificial Sequence
  synthetic Elaeis guineensis (oil palm) single nucleotide polymorphism (SNP) in genomic region adjacent to shatterproof1 (SHELL) shell thickness gene
gatgctgaatcgacgaagaaggtartgtgggagaagtttctgtcatgact

SEQ ID NO: 5659 - DNA, 50 bp, Artificial Sequence
  synthetic Elaeis guineensis (oil palm) single nucleotide polymorphism (SNP) in genomic region adjacent to shatterproof1 (SHELL) shell thickness gene
cttggattcataaattcaatttctktcatcattgtacatcaggtttctga

SEQ ID NO: 5660 - DNA, 50 bp, Artificial Sequence
  synthetic Elaeis guineensis (oil palm) single nucleotide polymorphism (SNP) in genomic region adjacent to shatterproof1 (SHELL) shell thickness gene
agttgaggaagccttgggtaacgtrcttcatctctgcttgagccacttgt

SEQ ID NO: 5661 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgggtaacgtgcttcatctctgctygagccacttgtataaaaatcatata

SEQ ID NO: 5662 - DNA, 50 bp, Artificial Sequence
  synthetic Elaeis guineensis (oil palm) single nucleotide polymorphism (SNP) in genomic region adjacent to shatterproof1 (SHELL) shell thickness gene
atatgattgttacagtgtcaggctkgccagccctggctttggattgggcc

SEQ ID NO: 5663 - DNA, 50 bp, Artificial Sequence; identical to SEQ ID NO: 5652
  synthetic Elaeis guineensis (oil palm) single nucleotide polymorphism (SNP) in genomic region adjacent to shatterproof1 (SHELL) shell thickness gene

SEQ ID NO: 5664 - DNA, 50 bp, Artificial Sequence; identical to SEQ ID NO: 5651
  synthetic Elaeis guineensis (oil palm) single nucleotide polymorphism (SNP) in genomic region adjacent to shatterproof1 (SHELL) shell thickness gene

SEQ ID NO: 5665 - DNA, 50 bp, Artificial Sequence; identical to SEQ ID NO: 5649
  synthetic Elaeis guineensis (oil palm) single nucleotide polymorphism (SNP) in genomic region adjacent to shatterproof1 (SHELL) shell thickness gene

SEQ ID NO: 5666 - DNA, 50 bp, Artificial Sequence; identical to SEQ ID NO: 5648
  synthetic Elaeis guineensis (oil palm) single nucleotide polymorphism (SNP) in genomic region adjacent to shatterproof1 (SHELL) shell thickness gene

SEQ ID NO: 5667 - DNA, 50 bp, Artificial Sequence; identical to SEQ ID NO: 5647
  synthetic Elaeis guineensis (oil palm) single nucleotide polymorphism (SNP) in genomic region adjacent to shatterproof1 (SHELL) shell thickness gene

SEQ ID NO: 5668 - DNA, 50 bp, Artificial Sequence; identical to SEQ ID NO: 5646
  synthetic Elaeis guineensis (oil palm) single nucleotide polymorphism (SNP) in genomic region adjacent to shatterproof1 (SHELL) shell thickness gene

SEQ ID NO: 5669 - DNA, 50 bp, Artificial Sequence; identical to SEQ ID NO: 5645
  synthetic Elaeis guineensis (oil palm) single nucleotide polymorphism (SNP) in genomic region adjacent to shatterproof1 (SHELL) shell thickness gene

SEQ ID NO: 5670 - DNA, 50 bp, Artificial Sequence; identical to SEQ ID NO: 5644
  synthetic Elaeis guineensis (oil palm) single nucleotide polymorphism (SNP) in genomic region adjacent to shatterproof1 (SHELL) shell thickness gene

SEQ ID NO: 5671 - DNA, 50 bp, Artificial Sequence
  synthetic Elaeis guineensis (oil palm) single nucleotide polymorphism (SNP) in genomic region adjacent to shatterproof1 (SHELL) shell thickness gene
atcattttgtctgcaatatgtttgrcagaagaacaaatcatttgcaggcc

SEQ ID NO: 5672 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaggcgcaaatgcgagagtaattakaatctactggggctatttatatata

SEQ ID NO: 5673 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaggtacagagccaccatttgttcyggaagctctctaccattgcagtgca

SEQ ID NO: 5674 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttccgccttcgccacattcgaattycatcgcaaattcgcctccaagtcca

SEQ ID NO: 5675 - DNA, 50 bp, Artificial Sequence
  synthetic Elaeis guineensis (oil palm) single nucleotide polymorphism (SNP) in genomic region adjacent to shatterproof1 (SHELL) shell thickness gene
aggtcctcctagctaacaattagcygatccaatgcttgtaacttttacaa

SEQ ID NO: 5676 - DNA, 50 bp, Artificial Sequence
  synthetic Elaeis guineensis (oil palm) single nucleotide polymorphism (SNP) in genomic region adjacent to shatterproof1 (SHELL) shell thickness gene
attgaattgcaacatttgcaattasgtcctcctagctaacaattagctga

SEQ ID NO: 5677 - DNA, 50 bp, Artificial Sequence
  synthetic Elaeis guineensis (oil palm) single nucleotide polymorphism (SNP) in genomic region adjacent to shatterproof1 (SHELL) shell thickness gene
agaacttggttttctaatttgatcycatcaaattgaattgcaacatttgc

SEQ ID NO: 5678 - DNA, 50 bp, Artificial Sequence
  synthetic Elaeis guineensis (oil palm) single nucleotide polymorphism (SNP) in genomic region adjacent to shatterproof1 (SHELL) shell thickness gene
aggtcaagcccaaactaattaggcytgatttaattaattagaacttggtt

SEQ ID NO: 5679 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggccgactagatggaggtggggtgygtggattagggtggaagcgacgaga

SEQ ID NO: 5680 - DNA, 50 bp, Artificial Sequence
  synthetic Elaeis guineensis (oil palm) single nucleotide polymorphism (SNP) in genomic region adjacent to shatterproof1 (SHELL) shell thickness gene
tagaagaagactcgcggatcaacaygcgaacacctttcgcatagaatcgg

SEQ ID NO: 5681 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccgacctctacacgtatccacacarggctgaagtagatcgaagtgtccga

SEQ ID NO: 5682 - DNA, 50 bp, Artificial Sequence
  synthetic Elaeis guineensis (oil palm) single nucleotide polymorphism (SNP) in genomic region adjacent to shatterproof1 (SHELL) shell thickness gene
aggttccgttgaaaccgcacatacrtccgacctctacacgtatccacaca

SEQ ID NO: 5683 - DNA, 50 bp, Artificial Sequence
  synthetic Elaeis guineensis (oil palm) single nucleotide polymorphism (SNP) in genomic region adjacent to shatterproof1 (SHELL) shell thickness gene
agttcatatgatgaaaaacaagatraaaacatgcatctgatttcaaaata

SEQ ID NO: 5684 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctagttcatatgatgaaaaacaagrtgaaaacatgcatctgatttcaaaa

SEQ ID NO: 5685 - DNA, 50 bp, Artificial Sequence
  synthetic Elaeis guineensis (oil palm) single nucleotide polymorphism (SNP) in genomic region adjacent to shatterproof1 (SHELL) shell thickness gene
gagtgagacttccgccaaatgagawaaatttgcttttccatattataagt

SEQ ID NO: 5686 - DNA, 50 bp, Artificial Sequence
  synthetic Elaeis guineensis (oil palm) single nucleotide polymorphism (SNP) in genomic region adjacent to shatterproof1 (SHELL) shell thickness gene
atccaatttcttgatgacccaggasgaaaatttatatagggacatgaagc

SEQ ID NO: 5687 - DNA, 50 bp, Artificial Sequence
  synthetic Elaeis guineensis (oil palm) single nucleotide polymorphism (SNP) in genomic region adjacent to shatterproof1 (SHELL) shell thickness gene
cgccaaaatgaaacatttaagccaytaccaaccgtatatttagttttgtt

SEQ ID NO: 5688 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttttaccacggcaactattgaatakatttggaaaaagaattttcagtggg

SEQ ID NO: 5689 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgaagacttgggtctccatgatttyagtatttgtgcttaacatcctttgg

SEQ ID NO: 5690 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaagacttgggtctccatgatttcrgtatttgtgcttaacatcctttgga

SEQ ID NO: 5691 - DNA, 50 bp, Artificial Sequence
  synthetic Elaeis guineensis (oil palm) single nucleotide polymorphism (SNP) in genomic region adjacent to shatterproof1 (SHELL) shell thickness gene
atctgagagaatggagagaagaccmgctttttcgtgctgcactaatggag

SEQ ID NO: 5692 - DNA, 50 bp, Artificial Sequence
  synthetic Elaeis guineensis (oil palm) single nucleotide polymorphism (SNP) in genomic region adjacent to shatterproof1 (SHELL) shell thickness gene
acatctgagagaatggagagaagayccgctttttcgtgctgcactaatgg

SEQ ID NO: 5693 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccaatctttattaataaagagctayacaagagtaggatacagataagctt

SEQ ID NO: 5694 - DNA, 50 bp, Artificial Sequence
  synthetic Elaeis guineensis (oil palm) single nucleotide polymorphism (SNP) in genomic region adjacent to shatterproof1 (SHELL) shell thickness gene
agttaggcttgatcagaagaacacragataggtgaaggggaagaaaaatt

SEQ ID NO: 5695 - DNA, 50 bp, Artificial Sequence
  synthetic Elaeis guineensis (oil palm) single nucleotide polymorphism (SNP) in genomic region adjacent to shatterproof1 (SHELL) shell thickness gene
acaatactgattcctggagatactyatagttaggcttgatcagaagaaca

SEQ ID NO: 5696 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctacaaaaatactaacacaactacmaatgcaaagacaaccttcttccttg

SEQ ID NO: 5697 - DNA, 50 bp, Artificial Sequence; identical to SEQ ID NO: 5695
  synthetic Elaeis guineensis (oil palm) single nucleotide polymorphism (SNP) in genomic region adjacent to shatterproof1 (SHELL) shell thickness gene

SEQ ID NO: 5698 - DNA, 50 bp, Artificial Sequence; identical to SEQ ID NO: 5694
  synthetic Elaeis guineensis (oil palm) single nucleotide polymorphism (SNP) in genomic region adjacent to shatterproof1 (SHELL) shell thickness gene

SEQ ID NO: 5699 - DNA, 50 bp, Artificial Sequence
  synthetic Elaeis guineensis (oil palm) single nucleotide polymorphism (SNP) in genomic region adjacent to shatterproof1 (SHELL) shell thickness gene
taggaagaaaactacaaaaatactwacacaactacaaatgcaaagacaac

SEQ ID NO: 5700 - DNA, 50 bp, Artificial Sequence
  synthetic Elaeis guineensis (oil palm) single nucleotide polymorphism (SNP) in genomic region adjacent to shatterproof1 (SHELL) shell thickness gene
gctggcaatgtgcacaggctacacwattctgtcaggttgggaactctcag

SEQ ID NO: 5701 - DNA, 50 bp, Artificial Sequence
  synthetic Elaeis guineensis (oil palm) single nucleotide polymorphism (SNP) in genomic region adjacent to shatterproof1 (SHELL) shell thickness gene
attcctcaatgctggcaatgtgcayaggctacacaattctgtcaggttgg

SEQ ID NO: 5702 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttgttagttggctctcaagctgctrctattccattgccttcaactttgca

SEQ ID NO: 5703 - DNA, 50 bp, Artificial Sequence
  synthetic Elaeis guineensis (oil palm) single nucleotide polymorphism (SNP) in genomic region adjacent to shatterproof1 (SHELL) shell thickness gene
cttattcagttgtattaaatacaayttattcatgctgtataatttaactt

SEQ ID NO: 5704 - DNA, 50 bp, Artificial Sequence; identical to SEQ ID NO: 5699
  synthetic Elaeis guineensis (oil palm) single nucleotide polymorphism (SNP) in genomic region adjacent to shatterproof1 (SHELL) shell thickness gene

SEQ ID NO: 5705 - DNA, 50 bp, Artificial Sequence
  synthetic Elaeis guineensis (oil palm) single nucleotide polymorphism (SNP) in genomic region adjacent to shatterproof1 (SHELL) shell thickness gene
gattcgagtggtgcgacgccagagmtcttgggttgccatctcaggtcttg

SEQ ID NO: 5706 - DNA, 50 bp, Artificial Sequence
  synthetic Elaeis guineensis (oil palm) single nucleotide polymorphism (SNP) in genomic region adjacent to shatterproof1 (SHELL) shell thickness gene
agaatgtaagataacagttcacagmaagatttaccgcaaaatcatctaat

SEQ ID NO: 5707 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttgtcagatacatagagaagttcaraacaactaaaaactaattgtacaat

SEQ ID NO: 5708 - DNA, 50 bp, Artificial Sequence
  synthetic Elaeis guineensis (oil palm) single nucleotide polymorphism (SNP) in genomic region adjacent to shatterproof1 (SHELL) shell thickness gene
agaaagggaaaagttatctggattragtagatatacattttgaactttga

SEQ ID NO: 5709 - DNA, 50 bp, Artificial Sequence
  synthetic Elaeis guineensis (oil palm) single nucleotide polymorphism (SNP) in genomic region adjacent to shatterproof1 (SHELL) shell thickness gene
cacttgaatctaggagggagatcaktttattattggattacttcttcccc

SEQ ID NO: 5710 - DNA, 50 bp, Artificial Sequence
  synthetic Elaeis guineensis (oil palm) single nucleotide polymorphism (SNP) in genomic region adjacent to shatterproof1 (SHELL) shell thickness gene
cctctgatatgtttcaaagccaacraaaccctttacatgttaccacactt

SEQ ID NO: 5711 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaaaaatcttaaattgaatcaatmgaaaagcatagttttaccatagccg

SEQ ID NO: 5712 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagaaataatagtaagcaaatgaargttatcaattgctggattaattttc

SEQ ID NO: 5713 - DNA, 50 bp, Artificial Sequence
  synthetic Elaeis guineensis (oil palm) single nucleotide polymorphism (SNP) in genomic region adjacent to shatterproof1 (SHELL) shell thickness gene
attttagacaggaactggtacaatkctaaagttacaattctaagtttcac

SEQ ID NO: 5714 - DNA, 50 bp, Artificial Sequence; identical to SEQ ID NO: 5709
  synthetic Elaeis guineensis (oil palm) single nucleotide polymorphism (SNP) in genomic region adjacent to shatterproof1 (SHELL) shell thickness gene

SEQ ID NO: 5715 - DNA, 50 bp, Artificial Sequence; identical to SEQ ID NO: 5706
  synthetic Elaeis guineensis (oil palm) single nucleotide polymorphism (SNP) in genomic region adjacent to shatterproof1 (SHELL) shell thickness gene

SEQ ID NO: 5716 - DNA, 50 bp, Artificial Sequence
  synthetic Elaeis guineensis (oil palm) single nucleotide polymorphism (SNP) in genomic region adjacent to shatterproof1 (SHELL) shell thickness gene
caaatttcatatcctttttctctawgaggtccattttatgccatggttgt

SEQ ID NO: 5717 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcttgctcggacacactttaattcscaaatattactcatgttgttttttt

SEQ ID NO: 5718 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatattaggggttagttctatcaayccttattcgttgagccttcccatta

SEQ ID NO: 5719 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttaaaaccttggtcctaaatattmggggttagttctatcaatccttatt

SEQ ID NO: 5720 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaaactcaaaaacttgaagataacwattaaaaccgttgaaacggctgaaa

SEQ ID NO: 5721 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttattttgtaaattttatcggctgktttcccgaaactcaaaaacttgaag

SEQ ID NO: 5722 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttatttttctcttattttgtaaawtttatcggctgttttcccgaaactc

SEQ ID NO: 5723 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcatcaaaagaatctcacaaaaacygtggattcctgtcctctttagtcct

SEQ ID NO: 5724 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctatgaagagactgtaaagaagtaygccaagctatgaaacatatacttgc

SEQ ID NO: 5725 - DNA, 50 bp, Artificial Sequence
  synthetic Elaeis guineensis (oil palm) single nucleotide polymorphism (SNP) in genomic region adjacent to shatterproof1 (SHELL) shell thickness gene
atccttcaaccacagggagaaaagyacttctgtcaacatctagggttact

SEQ ID NO: 5726 - DNA, 50 bp, Artificial Sequence; identical to SEQ ID NO: 5723
  synthetic Elaeis guineensis (oil palm) single nucleotide polymorphism (SNP) in genomic region adjacent to shatterproof1 (SHELL) shell thickness gene

SEQ ID NO: 5727 - DNA, 50 bp, Artificial Sequence; identical to SEQ ID NO: 5720
  synthetic Elaeis guineensis (oil palm) single nucleotide polymorphism (SNP) in genomic region adjacent to shatterproof1 (SHELL) shell thickness gene

SEQ ID NO: 5728 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctccactaaatttttcacctcatyacaaagctgttatgaagttggcctt

SEQ ID NO: 5729 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcttctcgattccttcgtaacattwgttgttgacatagaagatggtgcta

SEQ ID NO: 5730 - DNA, 50 bp, Artificial Sequence
  synthetic Elaeis guineensis (oil palm) single nucleotide polymorphism (SNP) in genomic region adjacent to shatterproof1 (SHELL) shell thickness gene
taacattatcttctcgattccttcrtaacatttgttgttgacatagaaga

SEQ ID NO: 5731 - DNA, 50 bp, Artificial Sequence
  synthetic Elaeis guineensis (oil palm) single nucleotide polymorphism (SNP) in genomic region adjacent to shatterproof1 (SHELL) shell thickness gene
caccttaccaattaaaatcctcaayctccattaaaaccctctccaccaac

SEQ ID NO: 5732 - DNA, 50 bp, Artificial Sequence
  synthetic Elaeis guineensis (oil palm) single nucleotide polymorphism (SNP) in genomic region adjacent to shatterproof1 (SHELL) shell thickness gene
acccaacaaccatgcacaacatacmatcattatgtgtttgttctacaaaa

SEQ ID NO: 5733 - DNA, 50 bp, Artificial Sequence
  synthetic Elaeis guineensis (oil palm) single nucleotide polymorphism (SNP) in genomic region adjacent to shatterproof1 (SHELL) shell thickness gene
tacccggtcttcccttttaccaacrcaacccaaacccaacaaccatgcac

SEQ ID NO: 5734 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatccatcattcaaactaaaacaaygcacccaggttgctcggaaattata

SEQ ID NO: 5735 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgcgaatccatcattcaaactaaamcaatgcacccaggttgctcggaaat

SEQ ID NO: 5736 - DNA, 50 bp, Artificial Sequence
  synthetic Elaeis guineensis (oil palm) single nucleotide polymorphism (SNP) in genomic region adjacent to shatterproof1 (SHELL) shell thickness gene
gccagcatgaagtaggaaaacaaayctagccatgtcttggaagaaaattc

SEQ ID NO: 5737 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagacaaataggtcggccagaaacmactttagccagcatgaagtaggaaa

SEQ ID NO: 5738 - DNA, 50 bp, Artificial Sequence
  synthetic Elaeis guineensis (oil palm) single nucleotide polymorphism (SNP) in genomic region adjacent to shatterproof1 (SHELL) shell thickness gene
ataggaaggaaccaagacaaatagrtcggccagaaaccactttagccagc

SEQ ID NO: 5739 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaggaaaaaaaaaatagtcctcctkgtcttacctttctctgattcaaaag

SEQ ID NO: 5740 - DNA, 50 bp, Artificial Sequence; identical to SEQ ID NO: 5737
  synthetic Elaeis guineensis (oil palm) single nucleotide polymorphism (SNP) in genomic region adjacent to shatterproof1 (SHELL) shell thickness gene

SEQ ID NO: 5741 - DNA, 50 bp, Artificial Sequence; identical to SEQ ID NO: 5735
  synthetic Elaeis guineensis (oil palm) single nucleotide polymorphism (SNP) in genomic region adjacent to shatterproof1 (SHELL) shell thickness gene

SEQ ID NO: 5742 - DNA, 50 bp, Artificial Sequence; identical to SEQ ID NO: 5734
  synthetic Elaeis guineensis (oil palm) single nucleotide polymorphism (SNP) in genomic region adjacent to shatterproof1 (SHELL) shell thickness gene

SEQ ID NO: 5743 - DNA, 50 bp, Artificial Sequence; identical to SEQ ID NO: 5732
  synthetic Elaeis guineensis (oil palm) single nucleotide polymorphism (SNP) in genomic region adjacent to shatterproof1 (SHELL) shell thickness gene

SEQ ID NO: 5744 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgatctttgtctgttattttgatgrcaatgcatttgttttgtggtctgtt

SEQ ID NO: 5745 - DNA, 50 bp, Artificial Sequence; identical to SEQ ID NO: 5731
  synthetic Elaeis guineensis (oil palm) single nucleotide polymorphism (SNP) in genomic region adjacent to shatterproof1 (SHELL) shell thickness gene

SEQ ID NO: 5746 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcaccaaaacatgctgccaggtacrattcttctggataatccgtcctctc

SEQ ID NO: 5747 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttcgtgtacgagctcgtctcgccaraaaaggttacgggaaggctcaaggt

SEQ ID NO: 5748 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgctatcggtttcgtgtacgagctygtctcgccaaaaaaggttacgggaa

SEQ ID NO: 5749 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaacatcatctccgtctccagcgaygatgacagcgtccatcgaccgaact

SEQ ID NO: 5750 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctagaagagaagaggtagctggggrctagctctgctttgaagcccaaacc

SEQ ID NO: 5751 - DNA, 50 bp, Artificial Sequence
  synthetic Elaeis guineensis (oil palm) single nucleotide polymorphism (SNP) in genomic region adjacent to shatterproof1 (SHELL) shell thickness gene
cagcaaccatgtgggcatgcgttarctggcttttttaatggtttaggtag

SEQ ID NO: 5752 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggtcagccagtggacttcacaccarcaaccatgtgggcatgcgttagctg

SEQ ID NO: 5753 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaggtggccttcccacccccaccayataccattattccattcaactctcc

SEQ ID NO: 5754 - DNA, 50 bp, Artificial Sequence
  synthetic Elaeis guineensis (oil palm) single nucleotide polymorphism (SNP) in genomic region adjacent to shatterproof1 (SHELL) shell thickness gene
gctttattggggaccggatgaagtygatgttacaacttcaatattatact

SEQ ID NO: 5755 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaagatcttctcatcttaaggccawtgcttcaggtgcataccaaatctta

SEQ ID NO: 5756 - DNA, 50 bp, Artificial Sequence; identical to SEQ ID NO: 5752
  synthetic Elaeis guineensis (oil palm) single nucleotide polymorphism (SNP) in genomic region adjacent to shatterproof1 (SHELL) shell thickness gene

SEQ ID NO: 5757 - DNA, 50 bp, Artificial Sequence; identical to SEQ ID NO: 5751
  synthetic Elaeis guineensis (oil palm) single nucleotide polymorphism (SNP) in genomic region adjacent to shatterproof1 (SHELL) shell thickness gene

SEQ ID NO: 5758 - DNA, 50 bp, Artificial Sequence; identical to SEQ ID NO: 5750
  synthetic Elaeis guineensis (oil palm) single nucleotide polymorphism (SNP) in genomic region adjacent to shatterproof1 (SHELL) shell thickness gene

SEQ ID NO: 5759 - DNA, 50 bp, Artificial Sequence; identical to SEQ ID NO: 5746
  synthetic Elaeis guineensis (oil palm) single nucleotide polymorphism (SNP) in genomic region adjacent to shatterproof1 (SHELL) shell thickness gene

SEQ ID NO: 5760 - DNA, 50 bp, Artificial Sequence
  synthetic Elaeis guineensis (oil palm) single nucleotide polymorphism (SNP) in genomic region adjacent to shatterproof1 (SHELL) shell thickness gene
tagcaccccaagcttgaagcaaatygctgtctagactgcagagaagaaca

SEQ ID NO: 5761 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtagaagcataatttgtttgtggcygaccaagcctcaaaaggagtaatag

SEQ ID NO: 5762 - DNA, 50 bp, Artificial Sequence
  synthetic Elaeis guineensis (oil palm) single nucleotide polymorphism (SNP) in genomic region adjacent to shatterproof1 (SHELL) shell thickness gene
caggctcttttttctctcatttctwtgttcttccctagactttctgaaag

SEQ ID NO: 5763 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggttaatcctcaggttatttttagwattaaaccagaaattcttccatgca

SEQ ID NO: 5764 - DNA, 50 bp, Artificial Sequence
  synthetic Elaeis guineensis (oil palm) single nucleotide polymorphism (SNP) in genomic region adjacent to shatterproof1 (SHELL) shell thickness gene
atgcaatttgtgatctatatatgcrtataaagtagcatcagtggtagtgt

SEQ ID NO: 5765 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctactactttgtaccttaatcgccrtgctcctaaactataaacaagaaca

SEQ ID NO: 5766 - DNA, 50 bp, Artificial Sequence
  synthetic Elaeis guineensis (oil palm) single nucleotide polymorphism (SNP) in genomic region adjacent to shatterproof1 (SHELL) shell thickness gene
tacctccatataagtacccaaaatyttttcaacaaatcatccatgataaa

SEQ ID NO: 5767 - DNA, 50 bp, Artificial Sequence
  synthetic Elaeis guineensis (oil palm) single nucleotide polymorphism (SNP) in genomic region adjacent to shatterproof1 (SHELL) shell thickness gene
cagttgaaaggtattatttgagttycttacctccatataagtacccaaaa

SEQ ID NO: 5768 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttttcgtgtttaaaatttcaaattyatatagatccattcataaatattat

SEQ ID NO: 5769 - DNA, 50 bp, Artificial Sequence
  synthetic Elaeis guineensis (oil palm) single nucleotide polymorphism (SNP) in genomic region adjacent to shatterproof1 (SHELL) shell thickness gene
caatcctaaattttttaagtaaatmactaatatgagataaaatacatgct

SEQ ID NO: 5770 - DNA, 50 bp, Artificial Sequence
  synthetic Elaeis guineensis (oil palm) single nucleotide polymorphism (SNP) in genomic region adjacent to shatterproof1 (SHELL) shell thickness gene
atttgaataccacgttcaaaaaaaytaatcagaagatattattcagattt

SEQ ID NO: 5771 - DNA, 50 bp, Artificial Sequence
  synthetic Elaeis guineensis (oil palm) single nucleotide polymorphism (SNP) in genomic region adjacent to shatterproof1 (SHELL) shell thickness gene
attaaaaaaaatcatcaaaaaaaayctttgtgggtatctatagtccaaaa

SEQ ID NO: 5772 - DNA, 50 bp, Artificial Sequence
  synthetic Elaeis guineensis (oil palm) single nucleotide polymorphism (SNP) in genomic region adjacent to shatterproof1 (SHELL) shell thickness gene
tagttgatttgaataaatttggatycttagcttgatgtgaacgtcaggac

SEQ ID NO: 5773 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttgtcatggaatttatgatacttwtagttgatttgaataaatttggatc

SEQ ID NO: 5774 - DNA, 50 bp, Artificial Sequence
  synthetic Elaeis guineensis (oil palm) single nucleotide polymorphism (SNP) in genomic region adjacent to shatterproof1 (SHELL) shell thickness gene
atcagagaggatttaacatatagcmtatatggactagggatactataaca

SEQ ID NO: 5775 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttgaaatgatatcagagaggatttracatatagcatatatggactaggga

SEQ ID NO: 5776 - DNA, 50 bp, Artificial Sequence
  synthetic Elaeis guineensis (oil palm) single nucleotide polymorphism (SNP) in genomic region adjacent to shatterproof1 (SHELL) shell thickness gene
caattttccacattaattaatcttyaatacaatttgtgaatcccttttgt

SEQ ID NO: 5777 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctgacggtgcatcataccgtacgckaagattccagagggtgaaaaattag

SEQ ID NO: 5778 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctactcagcctttaagaccacacarggacatctatttgctcgtaagaggg

SEQ ID NO: 5779 - DNA, 50 bp, Artificial Sequence
  synthetic Elaeis guineensis (oil palm) single nucleotide polymorphism (SNP) in genomic region adjacent to shatterproof1 (SHELL) shell thickness gene
atttcttccctcttcccatctctcrcttccttgctactctctctctttct

SEQ ID NO: 5780 - DNA, 50 bp, Artificial Sequence; identical to SEQ ID NO: 5778
  synthetic Elaeis guineensis (oil palm) single nucleotide polymorphism (SNP) in genomic region adjacent to shatterproof1 (SHELL) shell thickness gene

SEQ ID NO: 5781 - DNA, 50 bp, Artificial Sequence
  synthetic Elaeis guineensis (oil palm) single nucleotide polymorphism (SNP) in genomic region adjacent to shatterproof1 (SHELL) shell thickness gene
gctcttcttcttgaagccaagaaakccgagcaaacatttcttccctcttc

SEQ ID NO: 5782 - DNA, 50 bp, Artificial Sequence
  synthetic Elaeis guineensis (oil palm) single nucleotide polymorphism (SNP) in genomic region adjacent to shatterproof1 (SHELL) shell thickness gene
tggaccaacaatgcggggaagagcwactggcgatgggaaaatggactatg

SEQ ID NO: 5783 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggtggactgagttacataatgaaawcatggcataggtggaccaacaatgc

SEQ ID NO: 5784 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcaagctgaaaaatttagtggctgkggtggtggagtgcgatggtagagtt

SEQ ID NO: 5785 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagacagccttcttttcgtactaamatgtcctctgcccttctgtgttgta

SEQ ID NO: 5786 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaagtttggtatggtaatgatggyggtttgtgagtgcactccaagtaat

SEQ ID NO: 5787 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttttaatgagaaaaatatttttttytctttatgattcgtagaagaaaaat

SEQ ID NO: 5788 - DNA, 50 bp, Artificial Sequence; identical to SEQ ID NO: 5786
  synthetic Elaeis guineensis (oil palm) single nucleotide polymorphism (SNP) in genomic region adjacent to shatterproof1 (SHELL) shell thickness gene

SEQ ID NO: 5789 - DNA, 50 bp, Artificial Sequence
  synthetic Elaeis guineensis (oil palm) single nucleotide polymorphism (SNP) in genomic region adjacent to shatterproof1 (SHELL) shell thickness gene
ataggatgtcagaaaaaaagaagaratatttttttatttaaaaattttat

SEQ ID NO: 5790 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctcaaattataattttctgtataaratatcataattttttcataggatgt

SEQ ID NO: 5791 - DNA, 50 bp, Artificial Sequence; identical to SEQ ID NO: 5789
  synthetic Elaeis guineensis (oil palm) single nucleotide polymorphism (SNP) in genomic region adjacent to shatterproof1 (SHELL) shell thickness gene

SEQ ID NO: 5792 - DNA, 50 bp, Artificial Sequence
  synthetic Elaeis guineensis (oil palm) single nucleotide polymorphism (SNP) in genomic region adjacent to shatterproof1 (SHELL) shell thickness gene
cctacgctcaaattataattttctrtataaaatatcataattttttcata

SEQ ID NO: 5793 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttttcatttaaaattttgaatgatraaaatattcttcttcttctgaaaaa

SEQ ID NO: 5794 - DNA, 50 bp, Artificial Sequence; identical to SEQ ID NO: 5792
  synthetic Elaeis guineensis (oil palm) single nucleotide polymorphism (SNP) in genomic region adjacent to shatterproof1 (SHELL) shell thickness gene

SEQ ID NO: 5795 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtcgtcaattttattttttcatttraaattttgaatgataaaaatattct

SEQ ID NO: 5796 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctctatctgattgggtcatatagtyactgtttttcgatatgtatttaatg

SEQ ID NO: 5797 - DNA, 50 bp, Artificial Sequence
  synthetic Elaeis guineensis (oil palm) single nucleotide polymorphism (SNP) in genomic region adjacent to shatterproof1 (SHELL) shell thickness gene
gagattctttgtacaacgcatgtgktgtaggaaaaatataccactctatc

SEQ ID NO: 5798 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctagggatttaattagatattgggrtgaaagagattctttgtacaacgca

SEQ ID NO: 5799 - DNA, 50 bp, Artificial Sequence
  synthetic Elaeis guineensis (oil palm) single nucleotide polymorphism (SNP) in genomic region adjacent to shatterproof1 (SHELL) shell thickness gene
cttccagtctgccagacccactagrgatttaattagatattggggtgaaa

SEQ ID NO: 5800 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttagagaaaagatcaatcactttgwgaccaaggggctcccctagttatca

SEQ ID NO: 5801 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctgaggtttgaatctgaaatctctrttgaattttcttctcttttggaggg

SEQ ID NO: 5802 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctgaggtttgaatctgaaatctcyattgaattttcttctcttttggagg

SEQ ID NO: 5803 - DNA, 50 bp, Artificial Sequence
  synthetic Elaeis guineensis (oil palm) single nucleotide polymorphism (SNP) in genomic region adjacent to shatterproof1 (SHELL) shell thickness gene
cgaaagattcccagcaagccgtacwtcaatacctcatttttccaatctgt

SEQ ID NO: 5804 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttttaaagtctccatgtgcttgcamttggatattaattcataggtaggaa

SEQ ID NO: 5805 - DNA, 50 bp, Artificial Sequence
  synthetic Elaeis guineensis (oil palm) single nucleotide polymorphism (SNP) in genomic region adjacent to shatterproof1 (SHELL) shell thickness gene
tggcatccaacacgtgaaatgtccmcctaatttcggaagacctttgcatc

SEQ ID NO: 5806 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggaggatggaatgaatctaataccyccctctgtctgtatatataggggaa

SEQ ID NO: 5807 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaccattgtaaccgcctcaagagcktgagtcgtggtttctgggccttgat

SEQ ID NO: 5808 - DNA, 50 bp, Artificial Sequence
  synthetic Elaeis guineensis (oil palm) single nucleotide polymorphism (SNP) in genomic region adjacent to shatterproof1 (SHELL) shell thickness gene
acatcatgtaacttcacaaagaaarcgggaaagaaaaatgatacatgaat

SEQ ID NO: 5809 - DNA, 50 bp, Artificial Sequence
  synthetic Elaeis guineensis (oil palm) single nucleotide polymorphism (SNP) in genomic region adjacent to shatterproof1 (SHELL) shell thickness gene
cttgtccattttgtgggacatgaayataaaaaaactatatgcatgctatg

SEQ ID NO: 5810 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagccaaggatccacttaagtttaytaactctgtagagcaagattggaaa

SEQ ID NO: 5811 - DNA, 50 bp, Artificial Sequence
  synthetic Elaeis guineensis (oil palm) single nucleotide polymorphism (SNP) in genomic region adjacent to shatterproof1 (SHELL) shell thickness gene
cttgcccccaatcacatccctcttsttagcaatcagaggttattaaaaaa

SEQ ID NO: 5812 - DNA, 50 bp, Artificial Sequence
  synthetic Elaeis guineensis (oil palm) single nucleotide polymorphism (SNP) in genomic region adjacent to shatterproof1 (SHELL) shell thickness gene
taatagtaaaaggatattgtgtgckacgtcttgcccccaatcacatccct

SEQ ID NO: 5813 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcggacaactagcattccatggatrattgttagggggaacaatctataga

SEQ ID NO: 5814 - DNA, 50 bp, Artificial Sequence; identical to SEQ ID NO: 5812
  synthetic Elaeis guineensis (oil palm) single nucleotide polymorphism (SNP) in genomic region adjacent to shatterproof1 (SHELL) shell thickness gene

SEQ ID NO: 5815 - DNA, 50 bp, Artificial Sequence; identical to SEQ ID NO: 5811
  synthetic Elaeis guineensis (oil palm) single nucleotide polymorphism (SNP) in genomic region adjacent to shatterproof1 (SHELL) shell thickness gene

SEQ ID NO: 5816 - DNA, 50 bp, Artificial Sequence; identical to SEQ ID NO: 5810
  synthetic Elaeis guineensis (oil palm) single nucleotide polymorphism (SNP) in genomic region adjacent to shatterproof1 (SHELL) shell thickness gene

SEQ ID NO: 5817 - DNA, 50 bp, Artificial Sequence; identical to SEQ ID NO: 5809
  synthetic Elaeis guineensis (oil palm) single nucleotide polymorphism (SNP) in genomic region adjacent to shatterproof1 (SHELL) shell thickness gene

SEQ ID NO: 5818 - DNA, 50 bp, Artificial Sequence; identical to SEQ ID NO: 5808
  synthetic Elaeis guineensis (oil palm) single nucleotide polymorphism (SNP) in genomic region adjacent to shatterproof1 (SHELL) shell thickness gene

SEQ ID NO: 5819 - DNA, 50 bp, Artificial Sequence; identical to SEQ ID NO: 5807
  synthetic Elaeis guineensis (oil palm) single nucleotide polymorphism (SNP) in genomic region adjacent to shatterproof1 (SHELL) shell thickness gene

SEQ ID NO: 5820 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgctagcattggtcgttgtaccctytgctgctgccattgtaaaactagtg

SEQ ID NO: 5821 - DNA, 50 bp, Artificial Sequence; identical to SEQ ID NO: 5804
  synthetic Elaeis guineensis (oil palm) single nucleotide polymorphism (SNP) in genomic region adjacent to shatterproof1 (SHELL) shell thickness gene

SEQ ID NO: 5822 - DNA, 50 bp, Artificial Sequence; identical to SEQ ID NO: 5803
  synthetic Elaeis guineensis (oil palm) single nucleotide polymorphism (SNP) in genomic region adjacent to shatterproof1 (SHELL) shell thickness gene

SEQ ID NO: 5823 - DNA, 50 bp, Artificial Sequence; identical to SEQ ID NO: 5802
  synthetic Elaeis guineensis (oil palm) single nucleotide polymorphism (SNP) in genomic region adjacent to shatterproof1 (SHELL) shell thickness gene

SEQ ID NO: 5824 - DNA, 50 bp, Artificial Sequence; identical to SEQ ID NO: 5801
  synthetic Elaeis guineensis (oil palm) single nucleotide polymorphism (SNP) in genomic region adjacent to shatterproof1 (SHELL) shell thickness gene

SEQ ID NO: 5825 - DNA, 50 bp, Artificial Sequence; identical to SEQ ID NO: 5800
  synthetic Elaeis guineensis (oil palm) single nucleotide polymorphism (SNP) in genomic region adjacent to shatterproof1 (SHELL) shell thickness gene

SEQ ID NO: 5826 - DNA, 50 bp, Artificial Sequence; identical to SEQ ID NO: 5799
  synthetic Elaeis guineensis (oil palm) single nucleotide polymorphism (SNP) in genomic region adjacent to shatterproof1 (SHELL) shell thickness gene

SEQ ID NO: 5827 - DNA, 50 bp, Artificial Sequence; identical to SEQ ID NO: 5798
  synthetic Elaeis guineensis (oil palm) single nucleotide polymorphism (SNP) in genomic region adjacent to shatterproof1 (SHELL) shell thickness gene

SEQ ID NO: 5828 - DNA, 50 bp, Artificial Sequence
  synthetic Elaeis guineensis (oil palm) single nucleotide polymorphism (SNP) in genomic region adjacent to shatterproof1 (SHELL) shell thickness gene
gttacaattaagataatatgtgccsaacaatattaactcggacaactagc

SEQ ID NO: 5829 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtactatatgattgctaattgggtkacaattaagataatatgtgccgaac

SEQ ID NO: 5830 - DNA, 50 bp, Artificial Sequence
  synthetic Elaeis guineensis (oil palm) single nucleotide polymorphism (SNP) in genomic region adjacent to shatterproof1 (SHELL) shell thickness gene
ataaacaaatgtttcatgcatttasattgtacgtcattattagccggatc

SEQ ID NO: 5831 - DNA, 50 bp, Artificial Sequence
  synthetic Elaeis guineensis (oil palm) single nucleotide polymorphism (SNP) in genomic region adjacent to shatterproof1 (SHELL) shell thickness gene
cattaatattaattgattcttaccrattacaaacgaaaattttgtttata

SEQ ID NO: 5832 - DNA, 50 bp, Artificial Sequence
  synthetic Elaeis guineensis (oil palm) single nucleotide polymorphism (SNP) in genomic region adjacent to shatterproof1 (SHELL) shell thickness gene
atgtctccatcgatctctacgcagyactccttttaatttttatgttaaat

SEQ ID NO: 5833 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaatggtttcttctcactatagcartgattcgctagctggctagatgtct

SEQ ID NO: 5834 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcttgacttgtcctatatatatgtkcatggttgcttttgtggttaggctc

SEQ ID NO: 5835 - DNA, 50 bp, Artificial Sequence
  synthetic Elaeis guineensis (oil palm) single nucleotide polymorphism (SNP) in genomic region adjacent to shatterproof1 (SHELL) shell thickness gene
gattatgagttgattattggctgtragatgcatatctaatcagtcttaaa

SEQ ID NO: 5836 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttggacgtacgtacgtacgtacccyaacggactaggaagacgggattctt

SEQ ID NO: 5837 - DNA, 50 bp, Artificial Sequence; identical to SEQ ID NO: 5835
  synthetic Elaeis guineensis (oil palm) single nucleotide polymorphism (SNP) in genomic region adjacent to shatterproof1 (SHELL) shell thickness gene

SEQ ID NO: 5838 - DNA, 50 bp, Artificial Sequence
  synthetic Elaeis guineensis (oil palm) single nucleotide polymorphism (SNP) in genomic region adjacent to shatterproof1 (SHELL) shell thickness gene
atgccatggcttcttgacattatcyatccctttattcgtggctgaaccag

SEQ ID NO: 5839 - DNA, 50 bp, Artificial Sequence; identical to SEQ ID NO: 5834
  synthetic Elaeis guineensis (oil palm) single nucleotide polymorphism (SNP) in genomic region adjacent to shatterproof1 (SHELL) shell thickness gene

SEQ ID NO: 5840 - DNA, 50 bp, Artificial Sequence; identical to SEQ ID NO: 5833
  synthetic Elaeis guineensis (oil palm) single nucleotide polymorphism (SNP) in genomic region adjacent to shatterproof1 (SHELL) shell thickness gene

SEQ ID NO: 5841 - DNA, 50 bp, Artificial Sequence; identical to SEQ ID NO: 5832
  synthetic Elaeis guineensis (oil palm) single nucleotide polymorphism (SNP) in genomic region adjacent to shatterproof1 (SHELL) shell thickness gene

SEQ ID NO: 5842 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgacaaaatcatcaaagtctggcaytttatgataattctctttgtggttc

SEQ ID NO: 5843 - DNA, 50 bp, Artificial Sequence; identical to SEQ ID NO: 5831
  synthetic Elaeis guineensis (oil palm) single nucleotide polymorphism (SNP) in genomic region adjacent to shatterproof1 (SHELL) shell thickness gene

SEQ ID NO: 5844 - DNA, 50 bp, Artificial Sequence; identical to SEQ ID NO: 5829
  synthetic Elaeis guineensis (oil palm) single nucleotide polymorphism (SNP) in genomic region adjacent to shatterproof1 (SHELL) shell thickness gene

SEQ ID NO: 5845 - DNA, 50 bp, Artificial Sequence; identical to SEQ ID NO: 5828
  synthetic Elaeis guineensis (oil palm) single nucleotide polymorphism (SNP) in genomic region adjacent to shatterproof1 (SHELL) shell thickness gene

SEQ ID NO: 5846 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaaccatccaaatctcgatcaagawaggtatgtggtggataataggatga

SEQ ID NO: 5847 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaccaacctgcataccttaattccrtccagctacttggatgagttttctc

SEQ ID NO: 5848 - DNA, 50 bp, Artificial Sequence
  synthetic Elaeis guineensis (oil palm) single nucleotide polymorphism (SNP) in genomic region adjacent to shatterproof1 (SHELL) shell thickness gene
atatataagagatcgacgatgatcratctagcttgcagacatattgacac

SEQ ID NO: 5849 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcagccaaatatataagagatcgamgatgatcgatctagcttgcagacat

SEQ ID NO: 5850 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctatagatggagcttttctattccytctcttcctcctctccattttctat

SEQ ID NO: 5851 - DNA, 50 bp, Artificial Sequence
  synthetic Elaeis guineensis (oil palm) single nucleotide polymorphism (SNP) in genomic region adjacent to shatterproof1 (SHELL) shell thickness gene
actatagatggagcttttctattcmctctcttcctcctctccattttcta

SEQ ID NO: 5852 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggctcaatgtggaccaaattttaargtgtatttcctaacaagcatgcata

SEQ ID NO: 5853 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggaacttaccactcaatcgttgtayaagagtctctcaagaaaaaatccca

SEQ ID NO: 5854 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgagagaataaaataagatcaatayaagaggaacttaccactcaatcgtt

SEQ ID NO: 5855 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaagaagaaacaaaataagaaacayaatacaaatacgtggatcgatctca

SEQ ID NO: 5856 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctcgatcatcaccgctgcagcctayactctggcaccaccttgctctgata

SEQ ID NO: 5857 - DNA, 50 bp, Artificial Sequence
  synthetic Elaeis guineensis (oil palm) single nucleotide polymorphism (SNP) in genomic region adjacent to shatterproof1 (SHELL) shell thickness gene
cttgttggatgagcacgtctttcayccttgcctgccacaaagagaaattg

SEQ ID NO: 5858 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcacgctctatccctcaatcatccrcagttgataaaactgcctccatcga

SEQ ID NO: 5859 - DNA, 50 bp, Artificial Sequence; identical to SEQ ID NO: 5857
  synthetic Elaeis guineensis (oil palm) single nucleotide polymorphism (SNP) in genomic region adjacent to shatterproof1 (SHELL) shell thickness gene

SEQ ID NO: 5860 - DNA, 50 bp, Artificial Sequence; identical to SEQ ID NO: 5856
  synthetic Elaeis guineensis (oil palm) single nucleotide polymorphism (SNP) in genomic region adjacent to shatterproof1 (SHELL) shell thickness gene

SEQ ID NO: 5861 - DNA, 50 bp, Artificial Sequence; identical to SEQ ID NO: 5855
  synthetic Elaeis guineensis (oil palm) single nucleotide polymorphism (SNP) in genomic region adjacent to shatterproof1 (SHELL) shell thickness gene

SEQ ID NO: 5862 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgcatgccgaatctaaaatccactrctggaaagaagtagattcctcgtca

SEQ ID NO: 5863 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcaccagaaaattcattaaacttcratccctctgattagtccatccatct

SEQ ID NO: 5864 - DNA, 50 bp, Artificial Sequence
  synthetic Elaeis guineensis (oil palm) single nucleotide polymorphism (SNP) in genomic region adjacent to shatterproof1 (SHELL) shell thickness gene
agatccaaaaatttctttcccaccratggctccatggcagagcaacaaaa

SEQ ID NO: 5865 - DNA, 50 bp, Artificial Sequence
  synthetic Elaeis guineensis (oil palm) single nucleotide polymorphism (SNP) in genomic region adjacent to shatterproof1 (SHELL) shell thickness gene
gatcatcatgtccatcgtgaaaacsgatcaaagtctagacaatacctttc

SEQ ID NO: 5866 - DNA, 50 bp, Artificial Sequence; identical to SEQ ID NO: 5864
  synthetic Elaeis guineensis (oil palm) single nucleotide polymorphism (SNP) in genomic region adjacent to shatterproof1 (SHELL) shell thickness gene

SEQ ID NO: 5867 - DNA, 50 bp, Artificial Sequence
  synthetic Elaeis guineensis (oil palm) single nucleotide polymorphism (SNP) in genomic region adjacent to shatterproof1 (SHELL) shell thickness gene
agtcataccagccatgatgaaattwgttgcattatcggtaattacttgga

SEQ ID NO: 5868 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccatgatgaaattagttgcattatyggtaattacttggacaacatttgcc

SEQ ID NO: 5869 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaaataagacacagatgaattatyaagaaggagaccaaacagcaatcaa

SEQ ID NO: 5870 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggatggcaaaaattttatttgccawagatgcatcaaaattttataaatta

SEQ ID NO: 5871 - DNA, 50 bp, Artificial Sequence
  synthetic Elaeis guineensis (oil palm) single nucleotide polymorphism (SNP) in genomic region adjacent to shatterproof1 (SHELL) shell thickness gene
atagagattaaaaagcagtccaagrtctaagaatattcgttacgactgga

SEQ ID NO: 5872 - DNA, 50 bp, Artificial Sequence
  synthetic Elaeis guineensis (oil palm) single nucleotide polymorphism (SNP) in genomic region adjacent to shatterproof1 (SHELL) shell thickness gene
cagatgttatctttagtactgtacmctatagagattaaaaagcagtccaa

SEQ ID NO: 5873 - DNA, 50 bp, Artificial Sequence
  synthetic Elaeis guineensis (oil palm) single nucleotide polymorphism (SNP) in genomic region adjacent to shatterproof1 (SHELL) shell thickness gene
atgacatagtaaggttcaaataggyggagttggaatgggagagtcttcat

SEQ ID NO: 5874 - DNA, 50 bp, Artificial Sequence
  synthetic Elaeis guineensis (oil palm) single nucleotide polymorphism (SNP) in genomic region adjacent to shatterproof1 (SHELL) shell thickness gene
tagaattcaaacaaaagatgacatwgtaaggttcaaataggtggagttgg

SEQ ID NO: 5875 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgattttacctggtgggttacctgkctgggctatttaccgtccttccgtg

SEQ ID NO: 5876 - DNA, 50 bp, Artificial Sequence
  synthetic Elaeis guineensis (oil palm) single nucleotide polymorphism (SNP) in genomic region adjacent to shatterproof1 (SHELL) shell thickness gene
atgcgctcccaacatgattttaccyggtgggttacctggctgggctattt

SEQ ID NO: 5877 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcaatttaccatccagatacatgckctcccaacatgattttacctggtgg

SEQ ID NO: 5878 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaaaaaattaaaaataaagtcgaraggagggagagtaagagagcccaat

SEQ ID NO: 5879 - DNA, 50 bp, Artificial Sequence; identical to SEQ ID NO: 5874
  synthetic Elaeis guineensis (oil palm) single nucleotide polymorphism (SNP) in genomic region adjacent to shatterproof1 (SHELL) shell thickness gene

SEQ ID NO: 5880 - DNA, 50 bp, Artificial Sequence; identical to SEQ ID NO: 5873
  synthetic Elaeis guineensis (oil palm) single nucleotide polymorphism (SNP) in genomic region adjacent to shatterproof1 (SHELL) shell thickness gene

SEQ ID NO: 5881 - DNA, 50 bp, Artificial Sequence; identical to SEQ ID NO: 5872
  synthetic Elaeis guineensis (oil palm) single nucleotide polymorphism (SNP) in genomic region adjacent to shatterproof1 (SHELL) shell thickness gene

SEQ ID NO: 5882 - DNA, 50 bp, Artificial Sequence; identical to SEQ ID NO: 5871
  synthetic Elaeis guineensis (oil palm) single nucleotide polymorphism (SNP) in genomic region adjacent to shatterproof1 (SHELL) shell thickness gene

SEQ ID NO: 5883 - DNA, 50 bp, Artificial Sequence; identical to SEQ ID NO: 5870
  synthetic Elaeis guineensis (oil palm) single nucleotide polymorphism (SNP) in genomic region adjacent to shatterproof1 (SHELL) shell thickness gene

SEQ ID NO: 5884 - DNA, 50 bp, Artificial Sequence
  synthetic Elaeis guineensis (oil palm) single nucleotide polymorphism (SNP) in genomic region adjacent to shatterproof1 (SHELL) shell thickness gene
attttaaacaaatgcaaaaacaatwtgcaatgtagaattagaaattagaa

SEQ ID NO: 5885 - DNA, 50 bp, Artificial Sequence; identical to SEQ ID NO: 5869
  synthetic Elaeis guineensis (oil palm) single nucleotide polymorphism (SNP) in genomic region adjacent to shatterproof1 (SHELL) shell thickness gene

SEQ ID NO: 5886 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggtggtggtggaggcgaaagaggcrtcgctgtgagagattgaatggcttt

SEQ ID NO: 5887 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtgatcttgccatcgccatcgacayggttgaagacggcgaagaggtcgaa

SEQ ID NO: 5888 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttcgtttaacttgtggaatctcccyaatatcttccaacattagatctatg

SEQ ID NO: 5889 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaataattcatttttttcataatygaatccggactcaccctaataaaat

SEQ ID NO: 5890 - DNA, 50 bp, Artificial Sequence
  synthetic Elaeis guineensis (oil palm) single nucleotide polymorphism (SNP) in genomic region adjacent to shatterproof1 (SHELL) shell thickness gene
taaatatacattttaagccccactrgggtccaacgcatcttatattttcg

SEQ ID NO: 5891 - DNA, 50 bp, Artificial Sequence; identical to SEQ ID NO: 5889
  synthetic Elaeis guineensis (oil palm) single nucleotide polymorphism (SNP) in genomic region adjacent to shatterproof1 (SHELL) shell thickness gene

SEQ ID NO: 5892 - DNA, 50 bp, Artificial Sequence
  synthetic Elaeis guineensis (oil palm) single nucleotide polymorphism (SNP) in genomic region adjacent to shatterproof1 (SHELL) shell thickness gene
gccaagtggtgatgtgttttggtcygcggtcaccttgcacgatgtatcaa

SEQ ID NO: 5893 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctttgtgtggctctcgtggacacmaaatatttttatatatgtttgcacg

SEQ ID NO: 5894 - DNA, 50 bp, Artificial Sequence
  synthetic Elaeis guineensis (oil palm) single nucleotide polymorphism (SNP) in genomic region adjacent to shatterproof1 (SHELL) shell thickness gene
gatgaccatgtccgcacttgatctkagccaaaaggctgagaaaggtatac

SEQ ID NO: 5895 - DNA, 50 bp, Artificial Sequence
  synthetic Elaeis guineensis (oil palm) single nucleotide polymorphism (SNP) in genomic region adjacent to shatterproof1 (SHELL) shell thickness gene
cggacaattgatttgattatagttrgtaaataagatgttatcggtgatga

SEQ ID NO: 5896 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcatttaaaagccgaaattaatgakgcttaagatgcttgaggatgtatct

SEQ ID NO: 5897 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttgaacaaaagaggagtaggtgtaraaccctttagcagggcaggcactat

SEQ ID NO: 5898 - DNA, 50 bp, Artificial Sequence; identical to SEQ ID NO: 5896
  synthetic Elaeis guineensis (oil palm) single nucleotide polymorphism (SNP) in genomic region adjacent to shatterproof1 (SHELL) shell thickness gene

SEQ ID NO: 5899 - DNA, 50 bp, Artificial Sequence
  synthetic Elaeis guineensis (oil palm) single nucleotide polymorphism (SNP) in genomic region adjacent to shatterproof1 (SHELL) shell thickness gene
caagtacacatgcatgcatgcatgyatgtatgaatccaaggttgatgtat

SEQ ID NO: 5900 - DNA, 50 bp, Artificial Sequence
  synthetic Elaeis guineensis (oil palm) single nucleotide polymorphism (SNP) in genomic region adjacent to shatterproof1 (SHELL) shell thickness gene
agttgtagttcctgccagggtccawtgttttgagctatacaattagagca

SEQ ID NO: 5901 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctaccagaaaagtagataaatacgwaaaccaaggccataggaattgcaga

SEQ ID NO: 5902 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatttagtaaagtgtttggagagakaggaagtattttttgtctttcaaaa

SEQ ID NO: 5903 - DNA, 50 bp, Artificial Sequence
  synthetic Elaeis guineensis (oil palm) single nucleotide polymorphism (SNP) in genomic region adjacent to shatterproof1 (SHELL) shell thickness gene
agagcttgaagaattatctgatttyaaaaataaaatattttttttggata

SEQ ID NO: 5904 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaactttcatatcgatcaatcattytgaaacttaaataaaagattttgga

SEQ ID NO: 5905 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatttttcaaataattggaacatamatttgaataaactctttttcgaaaa

SEQ ID NO: 5906 - DNA, 50 bp, Artificial Sequence
  synthetic Elaeis guineensis (oil palm) single nucleotide polymorphism (SNP) in genomic region adjacent to shatterproof1 (SHELL) shell thickness gene
atcttgcaatcgagtcaactcaaawtttttaaagaaatttagaaaaataa

SEQ ID NO: 5907 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcacagaaagagagtcattttgctrgatgatctagtcgaggaaaagcaaa

SEQ ID NO: 5908 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaggtagttagcctcgatatttaraggacaatttacttagattatgttc

SEQ ID NO: 5909 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaatttcaaattttcaatgaatccwacaggcatggtggaagatgtctttg

SEQ ID NO: 5910 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctttaagcttttgattgtacttgaygtacactaaatcactaagcttcttt

SEQ ID NO: 5911 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtaccaatcaatcatttatcaaaayttgtttaaaaatataatattactat

SEQ ID NO: 5912 - DNA, 50 bp, Artificial Sequence; identical to SEQ ID NO: 5901
  synthetic Elaeis guineensis (oil palm) single nucleotide polymorphism (SNP) in genomic region adjacent to shatterproof1 (SHELL) shell thickness gene

SEQ ID NO: 5913 - DNA, 50 bp, Artificial Sequence
  synthetic Elaeis guineensis (oil palm) single nucleotide polymorphism (SNP) in genomic region adjacent to shatterproof1 (SHELL) shell thickness gene
cctgttcaaacacactccaattacrctcacaaccagatgcacaccattcc

SEQ ID NO: 5914 - DNA, 50 bp, Artificial Sequence; identical to SEQ ID NO: 5900
  synthetic Elaeis guineensis (oil palm) single nucleotide polymorphism (SNP) in genomic region adjacent to shatterproof1 (SHELL) shell thickness gene

SEQ ID NO: 5915 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttcgcgtaaaagatacaacctacrtccataaagaaccagctcctcaagg

SEQ ID NO: 5916 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctaatagttatggcaaccaatactytatccaaatttgcttagatttaaat

SEQ ID NO: 5917 - DNA, 50 bp, Artificial Sequence
  synthetic Elaeis guineensis (oil palm) single nucleotide polymorphism (SNP) in genomic region adjacent to shatterproof1 (SHELL) shell thickness gene
catattaattttgctaatagttatkgcaaccaatactctatccaaatttg

SEQ ID NO: 5918 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatgtatgcataccctcacgtgaarccatcatgtgccccttgtatgtatg

SEQ ID NO: 5919 - DNA, 50 bp, Artificial Sequence
  synthetic Elaeis guineensis (oil palm) single nucleotide polymorphism (SNP) in genomic region adjacent to shatterproof1 (SHELL) shell thickness gene
catctttggtctgtgaaaggcttcrccaattatgtatgcataccctcacg

SEQ ID NO: 5920 - DNA, 50 bp, Artificial Sequence
  synthetic Elaeis guineensis (oil palm) single nucleotide polymorphism (SNP) in genomic region adjacent to shatterproof1 (SHELL) shell thickness gene
atgaaataatgaggtaggcgaagaycgatataaccgccattataccgtta

SEQ ID NO: 5921 - DNA, 50 bp, Artificial Sequence
  synthetic Elaeis guineensis (oil palm) single nucleotide polymorphism (SNP) in genomic region adjacent to shatterproof1 (SHELL) shell thickness gene
atctttttcttttggagtgcaaacrtaaataggtcaaaatttaaggaata

SEQ ID NO: 5922 - DNA, 50 bp, Artificial Sequence
  synthetic Elaeis guineensis (oil palm) single nucleotide polymorphism (SNP) in genomic region adjacent to shatterproof1 (SHELL) shell thickness gene
agattggtgggagaaagtcgataayggtgacaattgggaggaagatggtg

SEQ ID NO: 5923 - DNA, 50 bp, Artificial Sequence
  synthetic Elaeis guineensis (oil palm) single nucleotide polymorphism (SNP) in genomic region adjacent to shatterproof1 (SHELL) shell thickness gene
gggcgatggcagcgaaaagagcagrgaggaggtcgatgtctctctttttc

SEQ ID NO: 5924 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcaaaactcaacacgtggtttgatrgagatttttaagaataaaaaaaatc

SEQ ID NO: 5925 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatttttccttccttctctaacacytgctgccctagctactgcaccccat

SEQ ID NO: 5926 - DNA, 50 bp, Artificial Sequence; identical to SEQ ID NO: 5923
  synthetic Elaeis guineensis (oil palm) single nucleotide polymorphism (SNP) in genomic region adjacent to shatterproof1 (SHELL) shell thickness gene

SEQ ID NO: 5927 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttttagaagtttcttgattttagcrtgatcaaaactcaacacgtggtttg

SEQ ID NO: 5928 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcaacataaatgttctttttagaartttcttgattttagcatgatcaaaa

SEQ ID NO: 5929 - DNA, 50 bp, Artificial Sequence
  synthetic Elaeis guineensis (oil palm) single nucleotide polymorphism (SNP) in genomic region adjacent to shatterproof1 (SHELL) shell thickness gene
acacattatctattacgatgggccrtcaccataactcctatcatcattat

SEQ ID NO: 5930 - DNA, 50 bp, Artificial Sequence; identical to SEQ ID NO: 5927
  synthetic Elaeis guineensis (oil palm) single nucleotide polymorphism (SNP) in genomic region adjacent to shatterproof1 (SHELL) shell thickness gene

SEQ ID NO: 5931 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaagttatgtggagcttgatcacrttcaagctcagataagctcaagctc

SEQ ID NO: 5932 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtgttcatatataatcaattgttayactaaatgtagtgactgcccttcat

SEQ ID NO: 5933 - DNA, 50 bp, Artificial Sequence
  synthetic Elaeis guineensis (oil palm) single nucleotide polymorphism (SNP) in genomic region adjacent to shatterproof1 (SHELL) shell thickness gene
taagtttggtggctttgaatgtgargttgaagctgctgttgatcttgatc

SEQ ID NO: 5934 - DNA, 50 bp, Artificial Sequence
  synthetic Elaeis guineensis (oil palm) single nucleotide polymorphism (SNP) in genomic region adjacent to shatterproof1 (SHELL) shell thickness gene
taatggtttatctcaaaactagccrcccatcaatatggccacaatcatgc

SEQ ID NO: 5935 - DNA, 50 bp, Artificial Sequence
  synthetic Elaeis guineensis (oil palm) single nucleotide polymorphism (SNP) in genomic region adjacent to shatterproof1 (SHELL) shell thickness gene
taattattggatcaacactcatctytctatttaagtaaaaataatccaag

SEQ ID NO: 5936 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaaatattcaaatattttatattyatcaaaattaattattggatcaaca

SEQ ID NO: 5937 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgtggcttcttccatcttttttttrcactctataacttggcattgatgaa

SEQ ID NO: 5938 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcaatctcttcttctgaactagaaygaatctcttcatgatttaagtttgg

SEQ ID NO: 5939 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtcagctcttgacttttttcatttratttctcatgatgtggcttcttcca

SEQ ID NO: 5940 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttgtatatttctgaaatttatgcakaactagccataaaagttgttaaccg

SEQ ID NO: 5941 - DNA, 50 bp, Artificial Sequence
  synthetic Elaeis guineensis (oil palm) single nucleotide polymorphism (SNP) in genomic region adjacent to shatterproof1 (SHELL) shell thickness gene
attatgatttttcctcagattatarcttgattatttttcttaactaacaa

SEQ ID NO: 5942 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcctcaaaccatccttaaaaatttyattatgatttttcctcagattatag

SEQ ID NO: 5943 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatttattcctcaaaccatccttaraaattttattatgatttttcctcag

SEQ ID NO: 5944 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaaagtaaataataagacacaagyaaatacaaaaaaatttatagtgatt

SEQ ID NO: 5945 - DNA, 50 bp, Artificial Sequence
  synthetic Elaeis guineensis (oil palm) single nucleotide polymorphism (SNP) in genomic region adjacent to shatterproof1 (SHELL) shell thickness gene
attgtgtgtgtgtgtgtgacaaaamagattagcaatgcaatgtctagaac

SEQ ID NO: 5946 - DNA, 50 bp, Artificial Sequence
  synthetic Elaeis guineensis (oil palm) single nucleotide polymorphism (SNP) in genomic region adjacent to shatterproof1 (SHELL) shell thickness gene
atcttccatctccttcccgaaatamaaggaaaattaaggtaaaagaaagc

SEQ ID NO: 5947 - DNA, 50 bp, Artificial Sequence
  synthetic Elaeis guineensis (oil palm) single nucleotide polymorphism (SNP) in genomic region adjacent to shatterproof1 (SHELL) shell thickness gene
caagaaacagcacattggctgctawattgttccaaacgaaggaagttcta

SEQ ID NO: 5948 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggttgctttatatatatatatatayacaagcgatcaaattgatccttttg

SEQ ID NO: 5949 - DNA, 50 bp, Artificial Sequence
  synthetic Elaeis guineensis (oil palm) single nucleotide polymorphism (SNP) in genomic region adjacent to shatterproof1 (SHELL) shell thickness gene
tacggggaaaaatataaaacatgasgttgctttatatatatatatatata

SEQ ID NO: 5950 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctgccaattagtttgtatacgggraaaaatataaaacatgaggttgctt

SEQ ID NO: 5951 - DNA, 50 bp, Artificial Sequence
  synthetic Elaeis guineensis (oil palm) single nucleotide polymorphism (SNP) in genomic region adjacent to shatterproof1 (SHELL) shell thickness gene
taaaatttaaaatttggatggctaygcctcctgttacatcgggaaacaaa

SEQ ID NO: 5952 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttcttcaataatgttgtgggaaacygtattctattttagtttccctcccc

SEQ ID NO: 5953 - DNA, 50 bp, Artificial Sequence; identical to SEQ ID NO: 5947
  synthetic Elaeis guineensis (oil palm) single nucleotide polymorphism (SNP) in genomic region adjacent to shatterproof1 (SHELL) shell thickness gene

SEQ ID NO: 5954 - DNA, 50 bp, Artificial Sequence
  synthetic Elaeis guineensis (oil palm) single nucleotide polymorphism (SNP) in genomic region adjacent to shatterproof1 (SHELL) shell thickness gene
atatgtgtagctgccctctggaacrgaatgctttggtagagcataataag

SEQ ID NO: 5955 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgggtgggagtgagggtggagctgwggtggtgatggacttggtgggaggt

SEQ ID NO: 5956 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttctcacaaaccccacaatcatggmattccacgatacacggtttctctga

SEQ ID NO: 5957 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagcttgtttctcacaaaccccacwatcatggaattccacgatacacggt

SEQ ID NO: 5958 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgtggtggtcctcattgcagcacayacagccacctctatcaattagattt

SEQ ID NO: 5959 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaactgttgtttgcaagaaagatwccctgctgccaaattgggcagctgg

SEQ ID NO: 5960 - DNA, 50 bp, Artificial Sequence; identical to SEQ ID NO: 5957
  synthetic Elaeis guineensis (oil palm) single nucleotide polymorphism (SNP) in genomic region adjacent to shatterproof1 (SHELL) shell thickness gene

SEQ ID NO: 5961 - DNA, 50 bp, Artificial Sequence; identical to SEQ ID NO: 5956
  synthetic Elaeis guineensis (oil palm) single nucleotide polymorphism (SNP) in genomic region adjacent to shatterproof1 (SHELL) shell thickness gene

SEQ ID NO: 5962 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggtactaggcgctgaaaaagcgaamacctgattgaagtcagatgccatgt

SEQ ID NO: 5963 - DNA, 50 bp, Artificial Sequence
  synthetic Elaeis guineensis (oil palm) single nucleotide polymorphism (SNP) in genomic region adjacent to shatterproof1 (SHELL) shell thickness gene
cacctgcacaccataagctgaaggwtgtcctaccaatttgagcttcacaa

SEQ ID NO: 5964 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatttttaagcctggattggtactyatttttgggctattctatcttgtac

SEQ ID NO: 5965 - DNA, 50 bp, Artificial Sequence
  synthetic Elaeis guineensis (oil palm) single nucleotide polymorphism (SNP) in genomic region adjacent to shatterproof1 (SHELL) shell thickness gene
cactactaactataggatatcggtmaagtttattatgcaattctcctgtt

SEQ ID NO: 5966 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttccatttggaggggtgagatcasggggcaaacgccctgcactactaac

SEQ ID NO: 5967 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcaagggagggagacggtacctgtkggaattacctagaattgaagattga

SEQ ID NO: 5968 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaataaaagcaagggagggagacrgtacctgttggaattacctagaatt

SEQ ID NO: 5969 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgatcaaaattggtctcgaggaaarggagagggatggtggcttccaagaa

SEQ ID NO: 5970 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgtcaaatcaagaagttggagctcytgatgcaagaggagagctaaatgat

SEQ ID NO: 5971 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaatggtggtacttgtgagcccatkattgtcaaatcaagaagttggagct

SEQ ID NO: 5972 - DNA, 50 bp, Artificial Sequence
  synthetic Elaeis guineensis (oil palm) single nucleotide polymorphism (SNP) in genomic region adjacent to shatterproof1 (SHELL) shell thickness gene
acagttacagtaagagggacaaccwgctcaaaatagttttgtggctttct

SEQ ID NO: 5973 - DNA, 50 bp, Artificial Sequence; identical to SEQ ID NO: 5969
  synthetic Elaeis guineensis (oil palm) single nucleotide polymorphism (SNP) in genomic region adjacent to shatterproof1 (SHELL) shell thickness gene

SEQ ID NO: 5974 - DNA, 50 bp, Artificial Sequence
  synthetic Elaeis guineensis (oil palm) single nucleotide polymorphism (SNP) in genomic region adjacent to shatterproof1 (SHELL) shell thickness gene
ataaggagggaatggtataatgaasaggagacagttacagtaagagggac

SEQ ID NO: 5975 - DNA, 50 bp, Artificial Sequence
  synthetic Elaeis guineensis (oil palm) single nucleotide polymorphism (SNP) in genomic region adjacent to shatterproof1 (SHELL) shell thickness gene
gagagaatcgaagcaaaaagactcrtgagggcaattattacgcaaatata

SEQ ID NO: 5976 - DNA, 50 bp, Artificial Sequence
  synthetic Elaeis guineensis (oil palm) single nucleotide polymorphism (SNP) in genomic region adjacent to shatterproof1 (SHELL) shell thickness gene
agtggccaaaaaggaagtgtctacyagaaaattgagagagaatcgaagca

SEQ ID NO: 5977 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcaagaaaaaccagagcgagcaaamagggtagcaatgaagcagaacatgt

SEQ ID NO: 5978 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcccatgtgtttttttgcaagaaaraccagagcgagcaaaaagggtagca

SEQ ID NO: 5979 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatggtttggcgaggcccaaaaaawacattttagcctgattggggccaga

SEQ ID NO: 5980 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttctaacacaccttcgtagaatatmgatcaaaattaacgcaattaaatca

SEQ ID NO: 5981 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcttatctttgtagcccacagactytagctgaaagcagaaagaactaatg

SEQ ID NO: 5982 - DNA, 50 bp, Artificial Sequence
  synthetic Elaeis guineensis (oil palm) single nucleotide polymorphism (SNP) in genomic region adjacent to shatterproof1 (SHELL) shell thickness gene
atatttgtcgcttttgttgtccatwacattattgtggggtgcaaatcttt

SEQ ID NO: 5983 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttttcaatcctttaaaatttgtgcyagagaattaagaaaatccggatcct

SEQ ID NO: 5984 - DNA, 50 bp, Artificial Sequence; identical to SEQ ID NO: 5982
  synthetic Elaeis guineensis (oil palm) single nucleotide polymorphism (SNP) in genomic region adjacent to shatterproof1 (SHELL) shell thickness gene

SEQ ID NO: 5985 - DNA, 50 bp, Artificial Sequence; identical to SEQ ID NO: 5981
  synthetic Elaeis guineensis (oil palm) single nucleotide polymorphism (SNP) in genomic region adjacent to shatterproof1 (SHELL) shell thickness gene

SEQ ID NO: 5986 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcaaaagtattctatttatatttckataggtcaagaatgtttggtttgct

SEQ ID NO: 5987 - DNA, 50 bp, Artificial Sequence; identical to SEQ ID NO: 5980
  synthetic Elaeis guineensis (oil palm) single nucleotide polymorphism (SNP) in genomic region adjacent to shatterproof1 (SHELL) shell thickness gene

SEQ ID NO: 5988 - DNA, 50 bp, Artificial Sequence; identical to SEQ ID NO: 5979
  synthetic Elaeis guineensis (oil palm) single nucleotide polymorphism (SNP) in genomic region adjacent to shatterproof1 (SHELL) shell thickness gene

SEQ ID NO: 5989 - DNA, 50 bp, Artificial Sequence; identical to SEQ ID NO: 5978
  synthetic Elaeis guineensis (oil palm) single nucleotide polymorphism (SNP) in genomic region adjacent to shatterproof1 (SHELL) shell thickness gene

SEQ ID NO: 5990 - DNA, 50 bp, Artificial Sequence; identical to SEQ ID NO: 5977
  synthetic Elaeis guineensis (oil palm) single nucleotide polymorphism (SNP) in genomic region adjacent to shatterproof1 (SHELL) shell thickness gene

SEQ ID NO: 5991 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttccttttcaatcctttaaaatttrtgctagagaattaagaaaatccgga

SEQ ID NO: 5992 - DNA, 50 bp, Artificial Sequence
  synthetic Elaeis guineensis (oil palm) single nucleotide polymorphism (SNP) in genomic region adjacent to shatterproof1 (SHELL) shell thickness gene
agaattggagtcattttaatccaarttttagtgagattatttctgatttt

SEQ ID NO: 5993 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctaacgaggataaacaagaaaaayctaatgatttctccgatgaaaaccc

SEQ ID NO: 5994 - DNA, 50 bp, Artificial Sequence; identical to SEQ ID NO: 5992
  synthetic Elaeis guineensis (oil palm) single nucleotide polymorphism (SNP) in genomic region adjacent to shatterproof1 (SHELL) shell thickness gene

SEQ ID NO: 5995 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaggcttaataacttacctaggtcyaacgaggataaacaagaaaaaccta

SEQ ID NO: 5996 - DNA, 50 bp, Artificial Sequence
  synthetic Elaeis guineensis (oil palm) single nucleotide polymorphism (SNP) in genomic region adjacent to shatterproof1 (SHELL) shell thickness gene
gccatggccgtagaatactagccarcaaccaatgtcagcactcggtgcct

SEQ ID NO: 5997 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctctcttctttaaacaaagcacccraattttattctttttccctcttcat

SEQ ID NO: 5998 - DNA, 50 bp, Artificial Sequence
  synthetic Elaeis guineensis (oil palm) single nucleotide polymorphism (SNP) in genomic region adjacent to shatterproof1 (SHELL) shell thickness gene
aacactactagtccagaacctctcycagggtcaccaattgatctgggtta

SEQ ID NO: 5999 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaaaaataaatatacataatattrtttgtgtccaacaatccttatctct

SEQ ID NO: 6000 - DNA, 50 bp, Artificial Sequence
  synthetic Elaeis guineensis (oil palm) single nucleotide polymorphism (SNP) in genomic region adjacent to shatterproof1 (SHELL) shell thickness gene
tacctaaaccatctgaaaaccttcmatatttgatacgagcatatgacata

SEQ ID NO: 6001 - DNA, 50 bp, Artificial Sequence
  synthetic Elaeis guineensis (oil palm) single nucleotide polymorphism (SNP) in genomic region adjacent to shatterproof1 (SHELL) shell thickness gene
caagactattcgcaatctaacgtgsctaatccaaatatccctttcttaat

SEQ ID NO: 6002 - DNA, 50 bp, Artificial Sequence
  synthetic Elaeis guineensis (oil palm) single nucleotide polymorphism (SNP) in genomic region adjacent to shatterproof1 (SHELL) shell thickness gene
atgacaagactattcgcaatctaaygtgcctaatccaaatatccctttct

SEQ ID NO: 6003 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttctgtccatgacgagctattctyagtatcacatttctatccatgacaa

SEQ ID NO: 6004 - DNA, 50 bp, Artificial Sequence; identical to SEQ ID NO: 6001
  synthetic Elaeis guineensis (oil palm) single nucleotide polymorphism (SNP) in genomic region adjacent to shatterproof1 (SHELL) shell thickness gene

SEQ ID NO: 6005 - DNA, 50 bp, Artificial Sequence; identical to SEQ ID NO: 6000
  synthetic Elaeis guineensis (oil palm) single nucleotide polymorphism (SNP) in genomic region adjacent to shatterproof1 (SHELL) shell thickness gene

SEQ ID NO: 6006 - DNA, 50 bp, Artificial Sequence
  synthetic Elaeis guineensis (oil palm) single nucleotide polymorphism (SNP) in genomic region adjacent to shatterproof1 (SHELL) shell thickness gene
tggaccgctatgggaggtctaatcrtggatctatttaagttggggctagt

SEQ ID NO: 6007 - DNA, 50 bp, Artificial Sequence; identical to SEQ ID NO: 5999
  synthetic Elaeis guineensis (oil palm) single nucleotide polymorphism (SNP) in genomic region adjacent to shatterproof1 (SHELL) shell thickness gene

SEQ ID NO: 6008 - DNA, 50 bp, Artificial Sequence; identical to SEQ ID NO: 5997
  synthetic Elaeis guineensis (oil palm) single nucleotide polymorphism (SNP) in genomic region adjacent to shatterproof1 (SHELL) shell thickness gene

SEQ ID NO: 6009 - DNA, 50 bp, Artificial Sequence
  synthetic Elaeis guineensis (oil palm) single nucleotide polymorphism (SNP) in genomic region adjacent to shatterproof1 (SHELL) shell thickness gene
cacattaacataatctgaatcaatyaacagttatctttaggattctgaac

SEQ ID NO: 6010 - DNA, 50 bp, Artificial Sequence
  synthetic Elaeis guineensis (oil palm) single nucleotide polymorphism (SNP) in genomic region adjacent to shatterproof1 (SHELL) shell thickness gene
acaaaaatatatatcatatatcatyggatatccctcttcttcaaactatt

SEQ ID NO: 6011 - DNA, 50 bp, Artificial Sequence
  synthetic Elaeis guineensis (oil palm) single nucleotide polymorphism (SNP) in genomic region adjacent to shatterproof1 (SHELL) shell thickness gene
caaaagaaaatataagctataaaayctcgtatcatgtatccaatataact

SEQ ID NO: 6012 - DNA, 50 bp, Artificial Sequence
  synthetic Elaeis guineensis (oil palm) single nucleotide polymorphism (SNP) in genomic region adjacent to shatterproof1 (SHELL) shell thickness gene
atctgatcaaatttttcaattcgaratcccaaccttagctaaatatgaac

SEQ ID NO: 6013 - DNA, 50 bp, Artificial Sequence
  synthetic Elaeis guineensis (oil palm) single nucleotide polymorphism (SNP) in genomic region adjacent to shatterproof1 (SHELL) shell thickness gene
actgttattgatgatgttctatctratcaaatttttcaattcgagatccc

SEQ ID NO: 6014 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcaaattttatataatttataaaamtcaattattcaactgttattgatga

SEQ ID NO: 6015 - DNA, 50 bp, Artificial Sequence; identical to SEQ ID NO: 6010
  synthetic Elaeis guineensis (oil palm) single nucleotide polymorphism (SNP) in genomic region adjacent to shatterproof1 (SHELL) shell thickness gene

SEQ ID NO: 6016 - DNA, 50 bp, Artificial Sequence
  synthetic Elaeis guineensis (oil palm) single nucleotide polymorphism (SNP) in genomic region adjacent to shatterproof1 (SHELL) shell thickness gene
tattaacaaatatcaaattttatayaatttataaaactcaattattcaac

SEQ ID NO: 6017 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttcataataaatattttatattaayaaatatcaaattttatataatttat

SEQ ID NO: 6018 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtcggctacatgatgtgggcccatraaccttagagtaacatcctagagat

SEQ ID NO: 6019 - DNA, 50 bp, Artificial Sequence
  synthetic Elaeis guineensis (oil palm) single nucleotide polymorphism (SNP) in genomic region adjacent to shatterproof1 (SHELL) shell thickness gene
caaacccagcacccaggtcggctayatgatgtgggcccataaaccttaga

SEQ ID NO: 6020 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgtattagaagagccaaactaattraagtgctgaacaaactatgctggca

SEQ ID NO: 6021 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcacaagagctgataaatgttagcrtccgccaccgactccatttttgtct

SEQ ID NO: 6022 - DNA, 50 bp, Artificial Sequence; identical to SEQ ID NO: 6020
  synthetic Elaeis guineensis (oil palm) single nucleotide polymorphism (SNP) in genomic region adjacent to shatterproof1 (SHELL) shell thickness gene

SEQ ID NO: 6023 - DNA, 50 bp, Artificial Sequence; identical to SEQ ID NO: 6019
  synthetic Elaeis guineensis (oil palm) single nucleotide polymorphism (SNP) in genomic region adjacent to shatterproof1 (SHELL) shell thickness gene

SEQ ID NO: 6024 - DNA, 50 bp, Artificial Sequence; identical to SEQ ID NO: 6018
  synthetic Elaeis guineensis (oil palm) single nucleotide polymorphism (SNP) in genomic region adjacent to shatterproof1 (SHELL) shell thickness gene

SEQ ID NO: 6025 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccaacagccccactgaactggcagkgcaattcatgaaagttatcacactg

SEQ ID NO: 6026 - DNA, 50 bp, Artificial Sequence; identical to SEQ ID NO: 6017
  synthetic Elaeis guineensis (oil palm) single nucleotide polymorphism (SNP) in genomic region adjacent to shatterproof1 (SHELL) shell thickness gene

SEQ ID NO: 6027 - DNA, 50 bp, Artificial Sequence; identical to SEQ ID NO: 6016
  synthetic Elaeis guineensis (oil palm) single nucleotide polymorphism (SNP) in genomic region adjacent to shatterproof1 (SHELL) shell thickness gene

SEQ ID NO: 6028 - DNA, 50 bp, Artificial Sequence
  synthetic Elaeis guineensis (oil palm) single nucleotide polymorphism (SNP) in genomic region adjacent to shatterproof1 (SHELL) shell thickness gene
gatacaagaaccaaattatctcatygatgatctcctgctccatcatttgc

SEQ ID NO: 6029 - DNA, 50 bp, Artificial Sequence
  synthetic Elaeis guineensis (oil palm) single nucleotide polymorphism (SNP) in genomic region adjacent to shatterproof1 (SHELL) shell thickness gene
aattaatcagaaatggaatcatgtwcttctctatgtatatatccatgttt

SEQ ID NO: 6030 - DNA, 50 bp, Artificial Sequence
  synthetic Elaeis guineensis (oil palm) single nucleotide polymorphism (SNP) in genomic region adjacent to shatterproof1 (SHELL) shell thickness gene
gggacaattgtggagagggccaagwccaaccaatagcctaacaaggtgtc

SEQ ID NO: 6031 - DNA, 50 bp, Artificial Sequence
  synthetic Elaeis guineensis (oil palm) single nucleotide polymorphism (SNP) in genomic region adjacent to shatterproof1 (SHELL) shell thickness gene
agccatacatctcctagataacagyatgagatatggttgtaaactttgca

SEQ ID NO: 6032 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgatagaatatataaagttggggamaattgtggagagggccaagtccaac

SEQ ID NO: 6033 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttacttttcctaccactgtcttgtrtgacaatcttgtttgattgttgggt

SEQ ID NO: 6034 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtatgatgatttttcttaacaagaygggatttatgatttgaccttttctt

SEQ ID NO: 6035 - DNA, 50 bp, Artificial Sequence
  synthetic Elaeis guineensis (oil palm) single nucleotide polymorphism (SNP) in genomic region adjacent to shatterproof1 (SHELL) shell thickness gene
aacagcttcttccttaagccttttycttgcccctcccctcctaccattac

SEQ ID NO: 6036 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgcctcgttgtttctaaagttcacwgtctccataaagaatgcacctttgt

SEQ ID NO: 6037 - DNA, 50 bp, Artificial Sequence
  synthetic Elaeis guineensis (oil palm) single nucleotide polymorphism (SNP) in genomic region adjacent to shatterproof1 (SHELL) shell thickness gene
tggggaactccgatccaatcctttrgtctcgactggtgaaatcaaagctt

SEQ ID NO: 6038 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcttgcgtgtgaggatggaactcgyagcagaaccacacctccattgtcat

SEQ ID NO: 6039 - DNA, 50 bp, Artificial Sequence
  synthetic Elaeis guineensis (oil palm) single nucleotide polymorphism (SNP) in genomic region adjacent to shatterproof1 (SHELL) shell thickness gene
cacattggtatcaccaagtgggtcrgaggtcttgcgtgtgaggatggaac

SEQ ID NO: 6040 - DNA, 50 bp, Artificial Sequence
  synthetic Elaeis guineensis (oil palm) single nucleotide polymorphism (SNP) in genomic region adjacent to shatterproof1 (SHELL) shell thickness gene
acgaaatccaaacatttgttatcaygacactaaattaattttggacttcc

SEQ ID NO: 6041 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttattaaagtacgaaatccaaacwtttgttatcatgacactaaattaat

SEQ ID NO: 6042 - DNA, 50 bp, Artificial Sequence
  synthetic Elaeis guineensis (oil palm) single nucleotide polymorphism (SNP) in genomic region adjacent to shatterproof1 (SHELL) shell thickness gene
attgtggagtgaaagaaaatcatcrgagtaccattgactaggatggcaag

SEQ ID NO: 6043 - DNA, 50 bp, Artificial Sequence
  synthetic Elaeis guineensis (oil palm) single nucleotide polymorphism (SNP) in genomic region adjacent to shatterproof1 (SHELL) shell thickness gene
tataaggagaaagaggataatcttrgggaaatccgattgtggagtgaaag

SEQ ID NO: 6044 - DNA, 50 bp, Artificial Sequence
  synthetic Elaeis guineensis (oil palm) single nucleotide polymorphism (SNP) in genomic region adjacent to shatterproof1 (SHELL) shell thickness gene
accatcgcccaacctagcaagaaayagtcatttgtcaagagtaagtgagg

SEQ ID NO: 6045 - DNA, 50 bp, Artificial Sequence
  synthetic Elaeis guineensis (oil palm) single nucleotide polymorphism (SNP) in genomic region adjacent to shatterproof1 (SHELL) shell thickness gene
ataccatcgcccaacctagcaagaratagtcatttgtcaagagtaagtga

SEQ ID NO: 6046 - DNA, 50 bp, Artificial Sequence
  synthetic Elaeis guineensis (oil palm) single nucleotide polymorphism (SNP) in genomic region adjacent to shatterproof1 (SHELL) shell thickness gene
gccttcgatgaggtttaatctttargctaaagtagataaccaactttagt

SEQ ID NO: 6047 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctgccttcgatgaggtttaatcttyaggctaaagtagataaccaacttta

SEQ ID NO: 6048 - DNA, 50 bp, Artificial Sequence
  synthetic Elaeis guineensis (oil palm) single nucleotide polymorphism (SNP) in genomic region adjacent to shatterproof1 (SHELL) shell thickness gene
tactcccatgcccaaatactccctratcgtctgccttcgatgaggtttaa

SEQ ID NO: 6049 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctgacccatgatcgggacccctamgtagtgccacactttgacctactcc

SEQ ID NO: 6050 - DNA, 50 bp, Artificial Sequence
  synthetic Elaeis guineensis (oil palm) single nucleotide polymorphism (SNP) in genomic region adjacent to shatterproof1 (SHELL) shell thickness gene
catcctctccctaatgctttacttyatcttaatatactttgatctccaca

SEQ ID NO: 6051 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgattggaccaacatcacttgaccyatcatagatagcgacttgacttgcc

SEQ ID NO: 6052 - DNA, 50 bp, Artificial Sequence; identical to SEQ ID NO: 6050
  synthetic Elaeis guineensis (oil palm) single nucleotide polymorphism (SNP) in genomic region adjacent to shatterproof1 (SHELL) shell thickness gene

SEQ ID NO: 6053 - DNA, 50 bp, Artificial Sequence; identical to SEQ ID NO: 6048
  synthetic Elaeis guineensis (oil palm) single nucleotide polymorphism (SNP) in genomic region adjacent to shatterproof1 (SHELL) shell thickness gene

SEQ ID NO: 6054 - DNA, 50 bp, Artificial Sequence; identical to SEQ ID NO: 6047
  synthetic Elaeis guineensis (oil palm) single nucleotide polymorphism (SNP) in genomic region adjacent to shatterproof1 (SHELL) shell thickness gene

SEQ ID NO: 6055 - DNA, 50 bp, Artificial Sequence; identical to SEQ ID NO: 6046
  synthetic Elaeis guineensis (oil palm) single nucleotide polymorphism (SNP) in genomic region adjacent to shatterproof1 (SHELL) shell thickness gene

SEQ ID NO: 6056 - DNA, 50 bp, Artificial Sequence; identical to SEQ ID NO: 6045
  synthetic Elaeis guineensis (oil palm) single nucleotide polymorphism (SNP) in genomic region adjacent to shatterproof1 (SHELL) shell thickness gene

SEQ ID NO: 6057 - DNA, 50 bp, Artificial Sequence; identical to SEQ ID NO: 6044
  synthetic Elaeis guineensis (oil palm) single nucleotide polymorphism (SNP) in genomic region adjacent to shatterproof1 (SHELL) shell thickness gene

SEQ ID NO: 6058 - DNA, 50 bp, Artificial Sequence; identical to SEQ ID NO: 6043
  synthetic Elaeis guineensis (oil palm) single nucleotide polymorphism (SNP) in genomic region adjacent to shatterproof1 (SHELL) shell thickness gene

SEQ ID NO: 6059 - DNA, 50 bp, Artificial Sequence; identical to SEQ ID NO: 6041
  synthetic Elaeis guineensis (oil palm) single nucleotide polymorphism (SNP) in genomic region adjacent to shatterproof1 (SHELL) shell thickness gene

SEQ ID NO: 6060 - DNA, 50 bp, Artificial Sequence; identical to SEQ ID NO: 6040
  synthetic Elaeis guineensis (oil palm) single nucleotide polymorphism (SNP) in genomic region adjacent to shatterproof1 (SHELL) shell thickness gene

SEQ ID NO: 6061 - DNA, 50 bp, Artificial Sequence; identical to SEQ ID NO: 6039
  synthetic Elaeis guineensis (oil palm) single nucleotide polymorphism (SNP) in genomic region adjacent to shatterproof1 (SHELL) shell thickness gene

SEQ ID NO: 6062 - DNA, 50 bp, Artificial Sequence; identical to SEQ ID NO: 6038
  synthetic Elaeis guineensis (oil palm) single nucleotide polymorphism (SNP) in genomic region adjacent to shatterproof1 (SHELL) shell thickness gene

SEQ ID NO: 6063 - DNA, 50 bp, Artificial Sequence; identical to SEQ ID NO: 6037
  synthetic Elaeis guineensis (oil palm) single nucleotide polymorphism (SNP) in genomic region adjacent to shatterproof1 (SHELL) shell thickness gene

SEQ ID NO: 6064 - DNA, 50 bp, Artificial Sequence
  synthetic Elaeis guineensis (oil palm) single nucleotide polymorphism (SNP) in genomic region adjacent to shatterproof1 (SHELL) shell thickness gene
gctgattggaccaacatcacttgayccatcatagatagcgacttgacttg

SEQ ID NO: 6065 - DNA, 50 bp, Artificial Sequence
  synthetic Elaeis guineensis (oil palm) single nucleotide polymorphism (SNP) in genomic region adjacent to shatterproof1 (SHELL) shell thickness gene
tagttcaggctgaagagagagaggraagagagagaaactctctttctcat

SEQ ID NO: 6066 - DNA, 50 bp, Artificial Sequence
  synthetic Elaeis guineensis (oil palm) single nucleotide polymorphism (SNP) in genomic region adjacent to shatterproof1 (SHELL) shell thickness gene
agagagaaaatagagagagaaagtycaattttagagagagaaaatactag

SEQ ID NO: 6067 - DNA, 50 bp, Artificial Sequence
  synthetic Elaeis guineensis (oil palm) single nucleotide polymorphism (SNP) in genomic region adjacent to shatterproof1 (SHELL) shell thickness gene
gagagagaattttagagagagaaartagagagagaaagttcaattttaga

SEQ ID NO: 6068 - DNA, 50 bp, Artificial Sequence
  synthetic Elaeis guineensis (oil palm) single nucleotide polymorphism (SNP) in genomic region adjacent to shatterproof1 (SHELL) shell thickness gene
cacagatcaaaaattcatcatgagratcatttaaattcatcatcattctt

SEQ ID NO: 6069 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtcggtgtaccgtccgacgatcacrgatcaaaaattcatcatgagaatca

SEQ ID NO: 6070 - DNA, 50 bp, Artificial Sequence
  synthetic Elaeis guineensis (oil palm) single nucleotide polymorphism (SNP) in genomic region adjacent to shatterproof1 (SHELL) shell thickness gene
catgataaataaaatctaaaaatayctgatctgatcaaagtggatgtcgg

SEQ ID NO: 6071 - DNA, 50 bp, Artificial Sequence; identical to SEQ ID NO: 6069
  synthetic Elaeis guineensis (oil palm) single nucleotide polymorphism (SNP) in genomic region adjacent to shatterproof1 (SHELL) shell thickness gene

SEQ ID NO: 6072 - DNA, 50 bp, Artificial Sequence; identical to SEQ ID NO: 6068
  synthetic Elaeis guineensis (oil palm) single nucleotide polymorphism (SNP) in genomic region adjacent to shatterproof1 (SHELL) shell thickness gene

SEQ ID NO: 6073 - DNA, 50 bp, Artificial Sequence; identical to SEQ ID NO: 6066
  synthetic Elaeis guineensis (oil palm) single nucleotide polymorphism (SNP) in genomic region adjacent to shatterproof1 (SHELL) shell thickness gene

SEQ ID NO: 6074 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtgaacaattcaataaaatcatgakaaataaaatctaaaaatatctgatc

SEQ ID NO: 6075 - DNA, 50 bp, Artificial Sequence
  synthetic Elaeis guineensis (oil palm) single nucleotide polymorphism (SNP) in genomic region adjacent to shatterproof1 (SHELL) shell thickness gene
attagattaaagaaagagattgacytgcattaatataatcatatagttca

SEQ ID NO: 6076 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttgcaaaccatggtcatatggccrccattaaatcaaaactcaataattt

SEQ ID NO: 6077 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagcggctatatggcttagaagacyatcaactatgcctaagacatgctgc

SEQ ID NO: 6078 - DNA, 50 bp, Artificial Sequence
  synthetic Elaeis guineensis (oil palm) single nucleotide polymorphism (SNP) in genomic region adjacent to shatterproof1 (SHELL) shell thickness gene
agcagttatatggccttttttttgscgataaagcggctatatggcttaga

SEQ ID NO: 6079 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatctcctagctaagattaagaaaygaaatcaaaaccagtcggaaccaaa

SEQ ID NO: 6080 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttgcggaagtctgagtgaaaccatrgcttctatccgcgagcacggtttcg

SEQ ID NO: 6081 - DNA, 50 bp, Artificial Sequence
  synthetic Elaeis guineensis (oil palm) single nucleotide polymorphism (SNP) in genomic region adjacent to shatterproof1 (SHELL) shell thickness gene
gctattattgttatgcacattgccrtcatgatcggcatctggcttctcga

SEQ ID NO: 6082 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgttttctacattcatgccattctsatgtgcatcatgtggatatatacat

SEQ ID NO: 6083 - DNA, 50 bp, Artificial Sequence; identical to SEQ ID NO: 6080
  synthetic Elaeis guineensis (oil palm) single nucleotide polymorphism (SNP) in genomic region adjacent to shatterproof1 (SHELL) shell thickness gene

SEQ ID NO: 6084 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttaaaagaaaagaaaataggagcrtgattttgacattcaaatcatgatg

SEQ ID NO: 6085 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttcggtctcattccttcctgagakctgacgcttaacgcagtcgggcact

SEQ ID NO: 6086 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttttcggtctcattccttcctgagmgctgacgcttaacgcagtcgggcac

SEQ ID NO: 6087 - DNA, 50 bp, Artificial Sequence
  synthetic Elaeis guineensis (oil palm) single nucleotide polymorphism (SNP) in genomic region adjacent to shatterproof1 (SHELL) shell thickness gene
attcttttgacttacttcgctctgrttaccggattcttctccttcataat

SEQ ID NO: 6088 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagtagaagaattcagtacgcatcyatgattcttttgacttacttcgctc

SEQ ID NO: 6089 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcacaacaatccaagtagaagaatkcagtacgcatccatgattcttttga

SEQ ID NO: 6090 - DNA, 50 bp, Artificial Sequence
  synthetic Elaeis guineensis (oil palm) single nucleotide polymorphism (SNP) in genomic region adjacent to shatterproof1 (SHELL) shell thickness gene
agttgcatccaaactcactctttcwgacaaattatgcacttctgcagcac

SEQ ID NO: 6091 - DNA, 50 bp, Artificial Sequence
  synthetic Elaeis guineensis (oil palm) single nucleotide polymorphism (SNP) in genomic region adjacent to shatterproof1 (SHELL) shell thickness gene
aactaagaaggattattcgagtcargcaggttagttgcatccaaactcac

SEQ ID NO: 6092 - DNA, 50 bp, Artificial Sequence
  synthetic Elaeis guineensis (oil palm) single nucleotide polymorphism (SNP) in genomic region adjacent to shatterproof1 (SHELL) shell thickness gene
gttcagatatcaggcattcttcatytaagttatgaatccaaactaagaag

SEQ ID NO: 6093 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcattaaaaaacatgaacactaaakttagatggacaaaaattgtacctta

SEQ ID NO: 6094 - DNA, 50 bp, Artificial Sequence
  synthetic Elaeis guineensis (oil palm) single nucleotide polymorphism (SNP) in genomic region adjacent to shatterproof1 (SHELL) shell thickness gene
taaaagtgttattcgaaatcaatcrggcaacctctttcaaaattcaccac

SEQ ID NO: 6095 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtcgtcggttcttgttttctgtatytttttcaagtctaggcttcggtgat

SEQ ID NO: 6096 - DNA, 50 bp, Artificial Sequence
  synthetic Elaeis guineensis (oil palm) single nucleotide polymorphism (SNP) in genomic region adjacent to shatterproof1 (SHELL) shell thickness gene
cttctgccaaattatgcaaggcctwtctcaatcagccagtgcctgaaatg

SEQ ID NO: 6097 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctctcgatatacaaagggcagaccrtgaatgctgcccggaaagctctggg

SEQ ID NO: 6098 - DNA, 50 bp, Artificial Sequence
  synthetic Elaeis guineensis (oil palm) single nucleotide polymorphism (SNP) in genomic region adjacent to shatterproof1 (SHELL) shell thickness gene
tccgaacgagaattagcgtgttaasttgctgatttgcaataggataagct

SEQ ID NO: 6099 - DNA, 50 bp, Artificial Sequence
  synthetic Elaeis guineensis (oil palm) single nucleotide polymorphism (SNP) in genomic region adjacent to shatterproof1 (SHELL) shell thickness gene
agaaggggatgaatcttgttgtggyccaacgtaccagtcaccggttacaa

SEQ ID NO: 6100 - DNA, 50 bp, Artificial Sequence; identical to SEQ ID NO: 6098
  synthetic Elaeis guineensis (oil palm) single nucleotide polymorphism (SNP) in genomic region adjacent to shatterproof1 (SHELL) shell thickness gene

SEQ ID NO: 6101 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccaattcagtgagaaacatgattgragaaagttaaatgtgaaacagtttg

SEQ ID NO: 6102 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtgagtgagaatacaccaattcagygagaaacatgattggagaaagttaa

SEQ ID NO: 6103 - DNA, 50 bp, Artificial Sequence
  synthetic Elaeis guineensis (oil palm) single nucleotide polymorphism (SNP) in genomic region adjacent to shatterproof1 (SHELL) shell thickness gene
caaagctcttggctctgtttttaakggtcaattacttgtgttttgaaaag

SEQ ID NO: 6104 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctagtatgtttaaaaaaatgtggakgagatattcttttccatatgccaat

SEQ ID NO: 6105 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctcaaaatagattttatttatgcaytcgaccaatctcctagtatgtttaa

SEQ ID NO: 6106 - DNA, 50 bp, Artificial Sequence
  synthetic Elaeis guineensis (oil palm) single nucleotide polymorphism (SNP) in genomic region adjacent to shatterproof1 (SHELL) shell thickness gene
atacaatgctccatccaactgcaamagtggtttgcccccaaattcaaccc

SEQ ID NO: 6107 - DNA, 50 bp, Artificial Sequence; identical to SEQ ID NO: 6103
  synthetic Elaeis guineensis (oil palm) single nucleotide polymorphism (SNP) in genomic region adjacent to shatterproof1 (SHELL) shell thickness gene

SEQ ID NO: 6108 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaaacaataacaagacttctcttargtgccaaatttcattgctatcctgg

SEQ ID NO: 6109 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagctaaagacatgagagtgaagaytgaaacaataacaagacttctctta

SEQ ID NO: 6110 - DNA, 50 bp, Artificial Sequence
  synthetic Elaeis guineensis (oil palm) single nucleotide polymorphism (SNP) in genomic region adjacent to shatterproof1 (SHELL) shell thickness gene
tccaaacctttctggagaattgaaraacatatgaaaccaagaaacatcta

SEQ ID NO: 6111 - DNA, 50 bp, Artificial Sequence
  synthetic Elaeis guineensis (oil palm) single nucleotide polymorphism (SNP) in genomic region adjacent to shatterproof1 (SHELL) shell thickness gene
agaaattattagcactgtgcagggwaatgcatgcatgattttaagcagcc

SEQ ID NO: 6112 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgaagctgctttagagtaatatgcrgtatgatgatcaatttgttgcctca

SEQ ID NO: 6113 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgtgtgtgtgtgtgtgtgtgtgtgwgagagagagagagagagagattgga

SEQ ID NO: 6114 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttctcttcttacagctccggttctrtttagtgcctactagattttgttca

SEQ ID NO: 6115 - DNA, 50 bp, Artificial Sequence
  synthetic Elaeis guineensis (oil palm) single nucleotide polymorphism (SNP) in genomic region adjacent to shatterproof1 (SHELL) shell thickness gene
cacgatgcttaacatgtgcagcggyaaactgttttggtcttatcaagaaa

SEQ ID NO: 6116 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtttgatctgcggtgcttcaaccaygatgcttaacatgtgcagcggcaaa

SEQ ID NO: 6117 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcagatacaggatacaagcttcatwttgcttgttcattcttggtttgatc

SEQ ID NO: 6118 - DNA, 50 bp, Artificial Sequence
  synthetic Elaeis guineensis (oil palm) single nucleotide polymorphism (SNP) in genomic region adjacent to shatterproof1 (SHELL) shell thickness gene
gatcggtcacttgcagaatttgatmagatttatgacattattggcatcct

SEQ ID NO: 6119 - DNA, 50 bp, Artificial Sequence
  synthetic Elaeis guineensis (oil palm) single nucleotide polymorphism (SNP) in genomic region adjacent to shatterproof1 (SHELL) shell thickness gene
attcagattggatcttctattcatycatttcttgctagagatcggtcact

SEQ ID NO: 6120 - DNA, 50 bp, Artificial Sequence
  synthetic Elaeis guineensis (oil palm) single nucleotide polymorphism (SNP) in genomic region adjacent to shatterproof1 (SHELL) shell thickness gene
atttttgaaaggaagcctgaagatycagggtactatattctgctgtctaa

SEQ ID NO: 6121 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggcatgggagtttatcagaaagatkccagtgaaaccagatattgatgtat

SEQ ID NO: 6122 - DNA, 50 bp, Artificial Sequence
  synthetic Elaeis guineensis (oil palm) single nucleotide polymorphism (SNP) in genomic region adjacent to shatterproof1 (SHELL) shell thickness gene
cagaagaggcttgcactactacaaytccatgatagaagactatggtattc

SEQ ID NO: 6123 - DNA, 50 bp, Artificial Sequence
  synthetic Elaeis guineensis (oil palm) single nucleotide polymorphism (SNP) in genomic region adjacent to shatterproof1 (SHELL) shell thickness gene
caagtgtgggtgtctagaccttggraagaaggtttttgagcagatgacaa

SEQ ID NO: 6124 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttgcatgatttctgtgaataattcrctgatagatatgtactgcaagtgtg

SEQ ID NO: 6125 - DNA, 50 bp, Artificial Sequence
  synthetic Elaeis guineensis (oil palm) single nucleotide polymorphism (SNP) in genomic region adjacent to shatterproof1 (SHELL) shell thickness gene
gatgatctgtggaactatgcatcayggagattggttggaggccttgaatc

SEQ ID NO: 6126 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgttcagaattatcggctctcgagmagggcagacaggtccaggaatcgat

SEQ ID NO: 6127 - DNA, 50 bp, Artificial Sequence
  synthetic Elaeis guineensis (oil palm) single nucleotide polymorphism (SNP) in genomic region adjacent to shatterproof1 (SHELL) shell thickness gene
acccagcctcgtgttaggctcgcarcttgtcaacatctatgtcagccttg

SEQ ID NO: 6128 - DNA, 50 bp, Artificial Sequence
  synthetic Elaeis guineensis (oil palm) single nucleotide polymorphism (SNP) in genomic region adjacent to shatterproof1 (SHELL) shell thickness gene
cctcttccttcacctgagatcaackaccagtccccatgaagctagaaagc

SEQ ID NO: 6129 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaattcgcctccaagtccatctccsacgagccagtaccaggaatctcatc

SEQ ID NO: 6130 - DNA, 50 bp, Artificial Sequence; identical to SEQ ID NO: 6128
  synthetic Elaeis guineensis (oil palm) single nucleotide polymorphism (SNP) in genomic region adjacent to shatterproof1 (SHELL) shell thickness gene

SEQ ID NO: 6131 - DNA, 50 bp, Artificial Sequence; identical to SEQ ID NO: 6127
  synthetic Elaeis guineensis (oil palm) single nucleotide polymorphism (SNP) in genomic region adjacent to shatterproof1 (SHELL) shell thickness gene

SEQ ID NO: 6132 - DNA, 50 bp, Artificial Sequence; identical to SEQ ID NO: 6126
  synthetic Elaeis guineensis (oil palm) single nucleotide polymorphism (SNP) in genomic region adjacent to shatterproof1 (SHELL) shell thickness gene

SEQ ID NO: 6133 - DNA, 50 bp, Artificial Sequence; identical to SEQ ID NO: 6125
  synthetic Elaeis guineensis (oil palm) single nucleotide polymorphism (SNP) in genomic region adjacent to shatterproof1 (SHELL) shell thickness gene

SEQ ID NO: 6134 - DNA, 50 bp, Artificial Sequence; identical to SEQ ID NO: 6124
  synthetic Elaeis guineensis (oil palm) single nucleotide polymorphism (SNP) in genomic region adjacent to shatterproof1 (SHELL) shell thickness gene

SEQ ID NO: 6135 - DNA, 50 bp, Artificial Sequence; identical to SEQ ID NO: 6123
  synthetic Elaeis guineensis (oil palm) single nucleotide polymorphism (SNP) in genomic region adjacent to shatterproof1 (SHELL) shell thickness gene

SEQ ID NO: 6136 - DNA, 50 bp, Artificial Sequence; identical to SEQ ID NO: 6122
  synthetic Elaeis guineensis (oil palm) single nucleotide polymorphism (SNP) in genomic region adjacent to shatterproof1 (SHELL) shell thickness gene

SEQ ID NO: 6137 - DNA, 50 bp, Artificial Sequence; identical to SEQ ID NO: 6121
  synthetic Elaeis guineensis (oil palm) single nucleotide polymorphism (SNP) in genomic region adjacent to shatterproof1 (SHELL) shell thickness gene

SEQ ID NO: 6138 - DNA, 50 bp, Artificial Sequence; identical to SEQ ID NO: 6120
  synthetic Elaeis guineensis (oil palm) single nucleotide polymorphism (SNP) in genomic region adjacent to shatterproof1 (SHELL) shell thickness gene

SEQ ID NO: 6139 - DNA, 50 bp, Artificial Sequence; identical to SEQ ID NO: 6119
  synthetic Elaeis guineensis (oil palm) single nucleotide polymorphism (SNP) in genomic region adjacent to shatterproof1 (SHELL) shell thickness gene

SEQ ID NO: 6140 - DNA, 50 bp, Artificial Sequence; identical to SEQ ID NO: 6117
  synthetic Elaeis guineensis (oil palm) single nucleotide polymorphism (SNP) in genomic region adjacent to shatterproof1 (SHELL) shell thickness gene

SEQ ID NO: 6141 - DNA, 50 bp, Artificial Sequence; identical to SEQ ID NO: 6116
  synthetic Elaeis guineensis (oil palm) single nucleotide polymorphism (SNP) in genomic region adjacent to shatterproof1 (SHELL) shell thickness gene

SEQ ID NO: 6142 - DNA, 50 bp, Artificial Sequence; identical to SEQ ID NO: 6115
  synthetic Elaeis guineensis (oil palm) single nucleotide polymorphism (SNP) in genomic region adjacent to shatterproof1 (SHELL) shell thickness gene

SEQ ID NO: 6143 - DNA, 50 bp, Artificial Sequence; identical to SEQ ID NO: 6112
  synthetic Elaeis guineensis (oil palm) single nucleotide polymorphism (SNP) in genomic region adjacent to shatterproof1 (SHELL) shell thickness gene

SEQ ID NO: 6144 - DNA, 50 bp, Artificial Sequence; identical to SEQ ID NO: 6111
  synthetic Elaeis guineensis (oil palm) single nucleotide polymorphism (SNP) in genomic region adjacent to shatterproof1 (SHELL) shell thickness gene

SEQ ID NO: 6145 - DNA, 50 bp, Artificial Sequence; identical to SEQ ID NO: 5674
  synthetic Elaeis guineensis (oil palm) single nucleotide polymorphism (SNP) in genomic region adjacent to shatterproof1 (SHELL) shell thickness gene

SEQ ID NO: 6146 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgggggcaagcgacactctgacaawttggaagtcaatagccatgcccaac

SEQ ID NO: 6147 - DNA, 50 bp, Artificial Sequence; identical to SEQ ID NO: 5673
  synthetic Elaeis guineensis (oil palm) single nucleotide polymorphism (SNP) in genomic region adjacent to shatterproof1 (SHELL) shell thickness gene

SEQ ID NO: 6148 - DNA, 50 bp, Artificial Sequence; identical to SEQ ID NO: 5672
  synthetic Elaeis guineensis (oil palm) single nucleotide polymorphism (SNP) in genomic region adjacent to shatterproof1 (SHELL) shell thickness gene

SEQ ID NO: 6149 - DNA, 50 bp, Artificial Sequence; identical to SEQ ID NO: 5671
  synthetic Elaeis guineensis (oil palm) single nucleotide polymorphism (SNP) in genomic region adjacent to shatterproof1 (SHELL) shell thickness gene

SEQ ID NO: 6150 - DNA, 50 bp, Artificial Sequence; identical to SEQ ID NO: 5662
  synthetic Elaeis guineensis (oil palm) single nucleotide polymorphism (SNP) in genomic region adjacent to shatterproof1 (SHELL) shell thickness gene

SEQ ID NO: 6151 - DNA, 50 bp, Artificial Sequence; identical to SEQ ID NO: 5661
  synthetic Elaeis guineensis (oil palm) single nucleotide polymorphism (SNP) in genomic region adjacent to shatterproof1 (SHELL) shell thickness gene

SEQ ID NO: 6152 - DNA, 50 bp, Artificial Sequence; identical to SEQ ID NO: 5660
  synthetic Elaeis guineensis (oil palm) single nucleotide polymorphism (SNP) in genomic region adjacent to shatterproof1 (SHELL) shell thickness gene

SEQ ID NO: 6153 - DNA, 50 bp, Artificial Sequence; identical to SEQ ID NO: 5659
  synthetic Elaeis guineensis (oil palm) single nucleotide polymorphism (SNP) in genomic region adjacent to shatterproof1 (SHELL) shell thickness gene

SEQ ID NO: 6154 - DNA, 50 bp, Artificial Sequence; identical to SEQ ID NO: 5658
  synthetic Elaeis guineensis (oil palm) single nucleotide polymorphism (SNP) in genomic region adjacent to shatterproof1 (SHELL) shell thickness gene

SEQ ID NO: 6155 - DNA, 50 bp, Artificial Sequence; identical to SEQ ID NO: 5690
  synthetic Elaeis guineensis (oil palm) single nucleotide polymorphism (SNP) in genomic region adjacent to shatterproof1 (SHELL) shell thickness gene

SEQ ID NO: 6156 - DNA, 50 bp, Artificial Sequence; identical to SEQ ID NO: 5689
  synthetic Elaeis guineensis (oil palm) single nucleotide polymorphism (SNP) in genomic region adjacent to shatterproof1 (SHELL) shell thickness gene

SEQ ID NO: 6157 - DNA, 50 bp, Artificial Sequence; identical to SEQ ID NO: 5703
  synthetic Elaeis guineensis (oil palm) single nucleotide polymorphism (SNP) in genomic region adjacent to shatterproof1 (SHELL) shell thickness gene

SEQ ID NO: 6158 - DNA, 50 bp, Artificial Sequence; identical to SEQ ID NO: 5716
  synthetic Elaeis guineensis (oil palm) single nucleotide polymorphism (SNP) in genomic region adjacent to shatterproof1 (SHELL) shell thickness gene

SEQ ID NO: 6159 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttgggaaaccaacaggcctgacatrtactgtatgtctactgctttataag

SEQ ID NO: 6160 - DNA, 50 bp, Artificial Sequence; identical to SEQ ID NO: 5713
  synthetic Elaeis guineensis (oil palm) single nucleotide polymorphism (SNP) in genomic region adjacent to shatterproof1 (SHELL) shell thickness gene

SEQ ID NO: 6161 - DNA, 50 bp, Artificial Sequence; identical to SEQ ID NO: 5744
  synthetic Elaeis guineensis (oil palm) single nucleotide polymorphism (SNP) in genomic region adjacent to shatterproof1 (SHELL) shell thickness gene

SEQ ID NO: 6162 - DNA, 50 bp, Artificial Sequence; identical to SEQ ID NO: 5755
  synthetic Elaeis guineensis (oil palm) single nucleotide polymorphism (SNP) in genomic region adjacent to shatterproof1 (SHELL) shell thickness gene

SEQ ID NO: 6163 - DNA, 50 bp, Artificial Sequence; identical to SEQ ID NO: 5764
  synthetic Elaeis guineensis (oil palm) single nucleotide polymorphism (SNP) in genomic region adjacent to shatterproof1 (SHELL) shell thickness gene

SEQ ID NO: 6164 - DNA, 50 bp, Artificial Sequence; identical to SEQ ID NO: 5763
  synthetic Elaeis guineensis (oil palm) single nucleotide polymorphism (SNP) in genomic region adjacent to shatterproof1 (SHELL) shell thickness gene

SEQ ID NO: 6165 - DNA, 50 bp, Artificial Sequence; identical to SEQ ID NO: 5762
  synthetic Elaeis guineensis (oil palm) single nucleotide polymorphism (SNP) in genomic region adjacent to shatterproof1 (SHELL) shell thickness gene

SEQ ID NO: 6166 - DNA, 50 bp, Artificial Sequence; identical to SEQ ID NO: 5761
  synthetic Elaeis guineensis (oil palm) single nucleotide polymorphism (SNP) in genomic region adjacent to shatterproof1 (SHELL) shell thickness gene

SEQ ID NO: 6167 - DNA, 50 bp, Artificial Sequence
  synthetic Elaeis guineensis (oil palm) single nucleotide polymorphism (SNP) in genomic region adjacent to shatterproof1 (SHELL) shell thickness gene
cagccaagggcgcctcgcttgagcrcctaggcgcgcctagacgagcacct

SEQ ID NO: 6168 - DNA, 50 bp, Artificial Sequence
  synthetic Elaeis guineensis (oil palm) single nucleotide polymorphism (SNP) in genomic region adjacent to shatterproof1 (SHELL) shell thickness gene
aggaggctgaggtgctttcagccawgggcgcctcgcttgagcacctaggc

SEQ ID NO: 6169 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagcgagcgcttaggcggtagaggygcttgtctggaggaggctgaggtgc

SEQ ID NO: 6170 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaggcgagagccttgcgccttgctycaagcgagcgcttaggcggtagagg

SEQ ID NO: 6171 - DNA, 50 bp, Artificial Sequence
  synthetic Elaeis guineensis (oil palm) single nucleotide polymorphism (SNP) in genomic region adjacent to shatterproof1 (SHELL) shell thickness gene
gccaaaggcgagagccttgcgcctygctccaagcgagcgcttaggcggta

SEQ ID NO: 6172 - DNA, 50 bp, Artificial Sequence
  synthetic Elaeis guineensis (oil palm) single nucleotide polymorphism (SNP) in genomic region adjacent to shatterproof1 (SHELL) shell thickness gene
taaaacctatttgtttcttaatttyttttaataaattacttaagtacctt

SEQ ID NO: 6173 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctgtcaacttcaatggagggaaggraactactctagccgtccaaagtcca

SEQ ID NO: 6174 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaagaaggagaggagattaagagarggagaggagaaaataaattgtgaaa

SEQ ID NO: 6175 - DNA, 50 bp, Artificial Sequence; identical to SEQ ID NO: 5785
  synthetic Elaeis guineensis (oil palm) single nucleotide polymorphism (SNP) in genomic region adjacent to shatterproof1 (SHELL) shell thickness gene

SEQ ID NO: 6176 - DNA, 50 bp, Artificial Sequence; identical to SEQ ID NO: 5820
  synthetic Elaeis guineensis (oil palm) single nucleotide polymorphism (SNP) in genomic region adjacent to shatterproof1 (SHELL) shell thickness gene

SEQ ID NO: 6177 - DNA, 50 bp, Artificial Sequence; identical to SEQ ID NO: 5842
  synthetic Elaeis guineensis (oil palm) single nucleotide polymorphism (SNP) in genomic region adjacent to shatterproof1 (SHELL) shell thickness gene

SEQ ID NO: 6178 - DNA, 50 bp, Artificial Sequence; identical to SEQ ID NO: 5838
  synthetic Elaeis guineensis (oil palm) single nucleotide polymorphism (SNP) in genomic region adjacent to shatterproof1 (SHELL) shell thickness gene

SEQ ID NO: 6179 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggtagaacagacaagcaatatattkacaagcttcttctttttttcttctt

SEQ ID NO: 6180 - DNA, 50 bp, Artificial Sequence; identical to SEQ ID NO: 5847
  synthetic Elaeis guineensis (oil palm) single nucleotide polymorphism (SNP) in genomic region adjacent to shatterproof1 (SHELL) shell thickness gene

SEQ ID NO: 6181 - DNA, 50 bp, Artificial Sequence; identical to SEQ ID NO: 5846
  synthetic Elaeis guineensis (oil palm) single nucleotide polymorphism (SNP) in genomic region adjacent to shatterproof1 (SHELL) shell thickness gene

SEQ ID NO: 6182 - DNA, 50 bp, Artificial Sequence; identical to SEQ ID NO: 5863
  synthetic Elaeis guineensis (oil palm) single nucleotide polymorphism (SNP) in genomic region adjacent to shatterproof1 (SHELL) shell thickness gene

SEQ ID NO: 6183 - DNA, 50 bp, Artificial Sequence
  synthetic Elaeis guineensis (oil palm) single nucleotide polymorphism (SNP) in genomic region adjacent to shatterproof1 (SHELL) shell thickness gene
catcaatagattttacgaacattgwtccagcagggtagttcaccagaaaa

SEQ ID NO: 6184 - DNA, 50 bp, Artificial Sequence
  synthetic Elaeis guineensis (oil palm) single nucleotide polymorphism (SNP) in genomic region adjacent to shatterproof1 (SHELL) shell thickness gene
cagttgtaacatatgatgaagcatyaatagattttacgaacattgatcca

SEQ ID NO: 6185 - DNA, 50 bp, Artificial Sequence
  synthetic Elaeis guineensis (oil palm) single nucleotide polymorphism (SNP) in genomic region adjacent to shatterproof1 (SHELL) shell thickness gene
cattttctctccagttgtaacataygatgaagcatcaatagattttacga

SEQ ID NO: 6186 - DNA, 50 bp, Artificial Sequence; identical to SEQ ID NO: 5868
  synthetic Elaeis guineensis (oil palm) single nucleotide polymorphism (SNP) in genomic region adjacent to shatterproof1 (SHELL) shell thickness gene

SEQ ID NO: 6187 - DNA, 50 bp, Artificial Sequence; identical to SEQ ID NO: 5867
  synthetic Elaeis guineensis (oil palm) single nucleotide polymorphism (SNP) in genomic region adjacent to shatterproof1 (SHELL) shell thickness gene

SEQ ID NO: 6188 - DNA, 50 bp, Artificial Sequence; identical to SEQ ID NO: 5884
  synthetic Elaeis guineensis (oil palm) single nucleotide polymorphism (SNP) in genomic region adjacent to shatterproof1 (SHELL) shell thickness gene

SEQ ID NO: 6189 - DNA, 50 bp, Artificial Sequence; identical to SEQ ID NO: 5888
  synthetic Elaeis guineensis (oil palm) single nucleotide polymorphism (SNP) in genomic region adjacent to shatterproof1 (SHELL) shell thickness gene

SEQ ID NO: 6190 - DNA, 50 bp, Artificial Sequence
  synthetic Elaeis guineensis (oil palm) single nucleotide polymorphism (SNP) in genomic region adjacent to shatterproof1 (SHELL) shell thickness gene
cctcataatgtttagagcaccaacrtggttgtaaaaataaaaccggtaag

SEQ ID NO: 6191 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtgaactccctcataatgtttagarcaccaacgtggttgtaaaaataaaa

SEQ ID NO: 6192 - DNA, 50 bp, Artificial Sequence
  synthetic Elaeis guineensis (oil palm) single nucleotide polymorphism (SNP) in genomic region adjacent to shatterproof1 (SHELL) shell thickness gene
taatgtgcaaaatatgatttttccmgccctaactaagtccctcctttttg

SEQ ID NO: 6193 - DNA, 50 bp, Artificial Sequence; identical to SEQ ID NO: 5895
  synthetic Elaeis guineensis (oil palm) single nucleotide polymorphism (SNP) in genomic region adjacent to shatterproof1 (SHELL) shell thickness gene

SEQ ID NO: 6194 - DNA, 50 bp, Artificial Sequence; identical to SEQ ID NO: 5894
  synthetic Elaeis guineensis (oil palm) single nucleotide polymorphism (SNP) in genomic region adjacent to shatterproof1 (SHELL) shell thickness gene

SEQ ID NO: 6195 - DNA, 50 bp, Artificial Sequence; identical to SEQ ID NO: 6191
  synthetic Elaeis guineensis (oil palm) single nucleotide polymorphism (SNP) in genomic region adjacent to shatterproof1 (SHELL) shell thickness gene

SEQ ID NO: 6196 - DNA, 50 bp, Artificial Sequence; identical to SEQ ID NO: 5893
  synthetic Elaeis guineensis (oil palm) single nucleotide polymorphism (SNP) in genomic region adjacent to shatterproof1 (SHELL) shell thickness gene

SEQ ID NO: 6197 - DNA, 50 bp, Artificial Sequence; identical to SEQ ID NO: 5892
  synthetic Elaeis guineensis (oil palm) single nucleotide polymorphism (SNP) in genomic region adjacent to shatterproof1 (SHELL) shell thickness gene

SEQ ID NO: 6198 - DNA, 50 bp, Artificial Sequence; identical to SEQ ID NO: 6190
  synthetic Elaeis guineensis (oil palm) single nucleotide polymorphism (SNP) in genomic region adjacent to shatterproof1 (SHELL) shell thickness gene

SEQ ID NO: 6199 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaagtaagatataatgtgcaaaatmtgatttttccagccctaactaagtc

SEQ ID NO: 6200 - DNA, 50 bp, Artificial Sequence; identical to SEQ ID NO: 5913
  synthetic Elaeis guineensis (oil palm) single nucleotide polymorphism (SNP) in genomic region adjacent to shatterproof1 (SHELL) shell thickness gene

SEQ ID NO: 6201 - DNA, 50 bp, Artificial Sequence; identical to SEQ ID NO: 5911
  synthetic Elaeis guineensis (oil palm) single nucleotide polymorphism (SNP) in genomic region adjacent to shatterproof1 (SHELL) shell thickness gene

SEQ ID NO: 6202 - DNA, 50 bp, Artificial Sequence; identical to SEQ ID NO: 5910
  synthetic Elaeis guineensis (oil palm) single nucleotide polymorphism (SNP) in genomic region adjacent to shatterproof1 (SHELL) shell thickness gene

SEQ ID NO: 6203 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccttaacatccatagaattgactcyttgcatgccagactttccaatcaac

SEQ ID NO: 6204 - DNA, 50 bp, Artificial Sequence; identical to SEQ ID NO: 5920
  synthetic Elaeis guineensis (oil palm) single nucleotide polymorphism (SNP) in genomic region adjacent to shatterproof1 (SHELL) shell thickness gene

SEQ ID NO: 6205 - DNA, 50 bp, Artificial Sequence; identical to SEQ ID NO: 5919
  synthetic Elaeis guineensis (oil palm) single nucleotide polymorphism (SNP) in genomic region adjacent to shatterproof1 (SHELL) shell thickness gene

SEQ ID NO: 6206 - DNA, 50 bp, Artificial Sequence; identical to SEQ ID NO: 5918
  synthetic Elaeis guineensis (oil palm) single nucleotide polymorphism (SNP) in genomic region adjacent to shatterproof1 (SHELL) shell thickness gene

SEQ ID NO: 6207 - DNA, 50 bp, Artificial Sequence; identical to SEQ ID NO: 5925
  synthetic Elaeis guineensis (oil palm) single nucleotide polymorphism (SNP) in genomic region adjacent to shatterproof1 (SHELL) shell thickness gene

SEQ ID NO: 6208 - DNA, 50 bp, Artificial Sequence; identical to SEQ ID NO: 5933
  synthetic Elaeis guineensis (oil palm) single nucleotide polymorphism (SNP) in genomic region adjacent to shatterproof1 (SHELL) shell thickness gene

SEQ ID NO: 6209 - DNA, 50 bp, Artificial Sequence; identical to SEQ ID NO: 5938
  synthetic Elaeis guineensis (oil palm) single nucleotide polymorphism (SNP) in genomic region adjacent to shatterproof1 (SHELL) shell thickness gene

SEQ ID NO: 6210 - DNA, 50 bp, Artificial Sequence
  synthetic Elaeis guineensis (oil palm) single nucleotide polymorphism (SNP) in genomic region adjacent to shatterproof1 (SHELL) shell thickness gene
catacccaaaagactaaaacttttytgagttttctgttttctccattact

SEQ ID NO: 6211 - DNA, 50 bp, Artificial Sequence; identical to SEQ ID NO: 5945
  synthetic Elaeis guineensis (oil palm) single nucleotide polymorphism (SNP) in genomic region adjacent to shatterproof1 (SHELL) shell thickness gene

SEQ ID NO: 6212 - DNA, 50 bp, Artificial Sequence; identical to SEQ ID NO: 5944
  synthetic Elaeis guineensis (oil palm) single nucleotide polymorphism (SNP) in genomic region adjacent to shatterproof1 (SHELL) shell thickness gene

SEQ ID NO: 6213 - DNA, 50 bp, Artificial Sequence
  synthetic Elaeis guineensis (oil palm) single nucleotide polymorphism (SNP) in genomic region adjacent to shatterproof1 (SHELL) shell thickness gene
aacaccatacccaaaagactaaaayttttctgagttttctgttttctcca

SEQ ID NO: 6214 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggaaaaatagaaaataaatatagtytattctaaactaagtcttaattaca

SEQ ID NO: 6215 - DNA, 50 bp, Artificial Sequence; identical to SEQ ID NO: 5962
  synthetic Elaeis guineensis (oil palm) single nucleotide polymorphism (SNP) in genomic region adjacent to shatterproof1 (SHELL) shell thickness gene

SEQ ID NO: 6216 - DNA, 50 bp, Artificial Sequence; identical to SEQ ID NO: 5986
  synthetic Elaeis guineensis (oil palm) single nucleotide polymorphism (SNP) in genomic region adjacent to shatterproof1 (SHELL) shell thickness gene

SEQ ID NO: 6217 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttttcatcaccttggtgattgcttytgatcctattgatgttgcaaacatg

SEQ ID NO: 6218 - DNA, 50 bp, Artificial Sequence; identical to SEQ ID NO: 6006
  synthetic Elaeis guineensis (oil palm) single nucleotide polymorphism (SNP) in genomic region adjacent to shatterproof1 (SHELL) shell thickness gene

SEQ ID NO: 6219 - DNA, 50 bp, Artificial Sequence; identical to SEQ ID NO: 6025
  synthetic Elaeis guineensis (oil palm) single nucleotide polymorphism (SNP) in genomic region adjacent to shatterproof1 (SHELL) shell thickness gene

SEQ ID NO: 6220 - DNA, 50 bp, Artificial Sequence
  synthetic Elaeis guineensis (oil palm) single nucleotide polymorphism (SNP) in genomic region adjacent to shatterproof1 (SHELL) shell thickness gene
gatatggttgtaaactttgcaatawgaccccctaatttctgaggcaggcc

SEQ ID NO: 6221 - DNA, 50 bp, Artificial Sequence; identical to SEQ ID NO: 6031
  synthetic Elaeis guineensis (oil palm) single nucleotide polymorphism (SNP) in genomic region adjacent to shatterproof1 (SHELL) shell thickness gene

SEQ ID NO: 6222 - DNA, 50 bp, Artificial Sequence; identical to SEQ ID NO: 6034
  synthetic Elaeis guineensis (oil palm) single nucleotide polymorphism (SNP) in genomic region adjacent to shatterproof1 (SHELL) shell thickness gene

SEQ ID NO: 6223 - DNA, 50 bp, Artificial Sequence
  synthetic Elaeis guineensis (oil palm) single nucleotide polymorphism (SNP) in genomic region adjacent to shatterproof1 (SHELL) shell thickness gene
agtactgtgatggcttatgttggartatcggctacatgccaacaaaatta

SEQ ID NO: 6224 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctatctatcttctggtgatacactrgtggagaaatatactgagttattgt

SEQ ID NO: 6225 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgcaaaaattttatccataataatktaaattcaattttaactggctaact

SEQ ID NO: 6226 - DNA, 50 bp, Artificial Sequence
  synthetic Elaeis guineensis (oil palm) single nucleotide polymorphism (SNP) in genomic region adjacent to shatterproof1 (SHELL) shell thickness gene
tggtgaagaacttattattggtttytcaatgtgagatatgactccagcca

SEQ ID NO: 6227 - DNA, 50 bp, Artificial Sequence
  synthetic Elaeis guineensis (oil palm) single nucleotide polymorphism (SNP) in genomic region adjacent to shatterproof1 (SHELL) shell thickness gene
acccttaaaatggtgaagaacttaytattggtttttcaatgtgagatatg

SEQ ID NO: 6228 - DNA, 50 bp, Artificial Sequence
  synthetic Elaeis guineensis (oil palm) single nucleotide polymorphism (SNP) in genomic region adjacent to shatterproof1 (SHELL) shell thickness gene
gttttttaatatatcggctaccatygtagcagctatgttctatgtttttg

SEQ ID NO: 6229 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctgcgagaagattgatttcattawcaagcaatttgttttttaatatatc

SEQ ID NO: 6230 - DNA, 50 bp, Artificial Sequence
  synthetic Elaeis guineensis (oil palm) single nucleotide polymorphism (SNP) in genomic region adjacent to shatterproof1 (SHELL) shell thickness gene
atagttcttgatgtgttctcttccrcaagttgtatttcagaagtgcttgt

SEQ ID NO: 6231 - DNA, 50 bp, Artificial Sequence; identical to SEQ ID NO: 6229
  synthetic Elaeis guineensis (oil palm) single nucleotide polymorphism (SNP) in genomic region adjacent to shatterproof1 (SHELL) shell thickness gene

SEQ ID NO: 6232 - DNA, 50 bp, Artificial Sequence; identical to SEQ ID NO: 6228
  synthetic Elaeis guineensis (oil palm) single nucleotide polymorphism (SNP) in genomic region adjacent to shatterproof1 (SHELL) shell thickness gene

SEQ ID NO: 6233 - DNA, 50 bp, Artificial Sequence; identical to SEQ ID NO: 6227
  synthetic Elaeis guineensis (oil palm) single nucleotide polymorphism (SNP) in genomic region adjacent to shatterproof1 (SHELL) shell thickness gene

SEQ ID NO: 6234 - DNA, 50 bp, Artificial Sequence; identical to SEQ ID NO: 6226
  synthetic Elaeis guineensis (oil palm) single nucleotide polymorphism (SNP) in genomic region adjacent to shatterproof1 (SHELL) shell thickness gene

SEQ ID NO: 6235 - DNA, 50 bp, Artificial Sequence; identical to SEQ ID NO: 6225
  synthetic Elaeis guineensis (oil palm) single nucleotide polymorphism (SNP) in genomic region adjacent to shatterproof1 (SHELL) shell thickness gene

SEQ ID NO: 6236 - DNA, 50 bp, Artificial Sequence; identical to SEQ ID NO: 6224
  synthetic Elaeis guineensis (oil palm) single nucleotide polymorphism (SNP) in genomic region adjacent to shatterproof1 (SHELL) shell thickness gene

SEQ ID NO: 6237 - DNA, 50 bp, Artificial Sequence; identical to SEQ ID NO: 6223
  synthetic Elaeis guineensis (oil palm) single nucleotide polymorphism (SNP) in genomic region adjacent to shatterproof1 (SHELL) shell thickness gene

SEQ ID NO: 6238 - DNA, 50 bp, Artificial Sequence; identical to SEQ ID NO: 6074
  synthetic Elaeis guineensis (oil palm) single nucleotide polymorphism (SNP) in genomic region adjacent to shatterproof1 (SHELL) shell thickness gene

SEQ ID NO: 6239 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtctggaattacatagttcttgatrtgttctcttccgcaagttgtatttc

SEQ ID NO: 6240 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtagcctcggcctctgcgtcgtccratcctccgaggccagtgctttacga

SEQ ID NO: 6241 - DNA, 50 bp, Artificial Sequence; identical to SEQ ID NO: 6239
  synthetic Elaeis guineensis (oil palm) single nucleotide polymorphism (SNP) in genomic region adjacent to shatterproof1 (SHELL) shell thickness gene

SEQ ID NO: 6242 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtagttcgtctcctcctcttccctytccttcgtcggcggcggtggaggaa

SEQ ID NO: 6243 - DNA, 50 bp, Artificial Sequence
  synthetic Elaeis guineensis (oil palm) single nucleotide polymorphism (SNP) in genomic region adjacent to shatterproof1 (SHELL) shell thickness gene
gatgtaatagatcttattgccaaayctcgtccaagtgatccatgaaaggt

SEQ ID NO: 6244 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggctttttgagtttcattttataaytaagttttggatgtaatagatctta

SEQ ID NO: 6245 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaatagatccctcttatagttcagrctaaattttttaaaaatagaagata

SEQ ID NO: 6246 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaatttctttcaaccatcttaatayagagctctcaaaataataaataaat

SEQ ID NO: 6247 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagtcagcaaatttctagatatcayggaatgtgaaaagtcaccaaggaaa

SEQ ID NO: 6248 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcttttggagttgattatgaagtcrgcaaatttctagatatcatggaatg

SEQ ID NO: 6249 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctctcatacctggtgccaagtgamattttcatttaagctgtagagctga

SEQ ID NO: 6250 - DNA, 50 bp, Artificial Sequence
  synthetic Elaeis guineensis (oil palm) single nucleotide polymorphism (SNP) in genomic region adjacent to shatterproof1 (SHELL) shell thickness gene
taggctatataaaattatattaacragttgtattttagcattctaggtga

SEQ ID NO: 6251 - DNA, 50 bp, Artificial Sequence
  synthetic Elaeis guineensis (oil palm) single nucleotide polymorphism (SNP) in genomic region adjacent to shatterproof1 (SHELL) shell thickness gene
agttccttaggctatataaaattakattaacgagttgtattttagcattc

SEQ ID NO: 6252 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcttggtcaactccaagtaatgaayctcagatatatcaccctgatttgga

SEQ ID NO: 6253 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatggagggcctgccataaaacctrcaaggctatgtggcaggagggaagg

SEQ ID NO: 6254 - DNA, 50 bp, Artificial Sequence; identical to SEQ ID NO: 6251
  synthetic Elaeis guineensis (oil palm) single nucleotide polymorphism (SNP) in genomic region adjacent to shatterproof1 (SHELL) shell thickness gene

SEQ ID NO: 6255 - DNA, 50 bp, Artificial Sequence; identical to SEQ ID NO: 6250
  synthetic Elaeis guineensis (oil palm) single nucleotide polymorphism (SNP) in genomic region adjacent to shatterproof1 (SHELL) shell thickness gene

SEQ ID NO: 6256 - DNA, 50 bp, Artificial Sequence; identical to SEQ ID NO: 6249
  synthetic Elaeis guineensis (oil palm) single nucleotide polymorphism (SNP) in genomic region adjacent to shatterproof1 (SHELL) shell thickness gene

SEQ ID NO: 6257 - DNA, 50 bp, Artificial Sequence; identical to SEQ ID NO: 6248
  synthetic Elaeis guineensis (oil palm) single nucleotide polymorphism (SNP) in genomic region adjacent to shatterproof1 (SHELL) shell thickness gene

SEQ ID NO: 6258 - DNA, 50 bp, Artificial Sequence; identical to SEQ ID NO: 6247
  synthetic Elaeis guineensis (oil palm) single nucleotide polymorphism (SNP) in genomic region adjacent to shatterproof1 (SHELL) shell thickness gene

SEQ ID NO: 6259 - DNA, 50 bp, Artificial Sequence; identical to SEQ ID NO: 6246
  synthetic Elaeis guineensis (oil palm) single nucleotide polymorphism (SNP) in genomic region adjacent to shatterproof1 (SHELL) shell thickness gene

SEQ ID NO: 6260 - DNA, 50 bp, Artificial Sequence; identical to SEQ ID NO: 6245
  synthetic Elaeis guineensis (oil palm) single nucleotide polymorphism (SNP) in genomic region adjacent to shatterproof1 (SHELL) shell thickness gene

SEQ ID NO: 6261 - DNA, 50 bp, Artificial Sequence; identical to SEQ ID NO: 6244
  synthetic Elaeis guineensis (oil palm) single nucleotide polymorphism (SNP) in genomic region adjacent to shatterproof1 (SHELL) shell thickness gene

SEQ ID NO: 6262 - DNA, 50 bp, Artificial Sequence
  synthetic Elaeis guineensis (oil palm) single nucleotide polymorphism (SNP) in genomic region adjacent to shatterproof1 (SHELL) shell thickness gene
caacatcaatcttcaaaatgttgckggattacagccaatgcatcgcactt

SEQ ID NO: 6263 - DNA, 50 bp, Artificial Sequence
  synthetic Elaeis guineensis (oil palm) single nucleotide polymorphism (SNP) in genomic region adjacent to shatterproof1 (SHELL) shell thickness gene
taggacaaaaagttaattcagggaytaggattatgcctgggaatatgaaa

SEQ ID NO: 6264 - DNA, 50 bp, Artificial Sequence; identical to SEQ ID NO: 6262
  synthetic Elaeis guineensis (oil palm) single nucleotide polymorphism (SNP) in genomic region adjacent to shatterproof1 (SHELL) shell thickness gene

SEQ ID NO: 6265 - DNA, 50 bp, Artificial Sequence
  synthetic Elaeis guineensis (oil palm) single nucleotide polymorphism (SNP) in genomic region adjacent to shatterproof1 (SHELL) shell thickness gene
aggcaatcttcaccctccattaatrccatatggatatatttaggacaaaa

SEQ ID NO: 6266 - DNA, 50 bp, Artificial Sequence
  synthetic Elaeis guineensis (oil palm) single nucleotide polymorphism (SNP) in genomic region adjacent to shatterproof1 (SHELL) shell thickness gene
gataaccttctgttagattattgtmggtttctttttcctttttttttttt

SEQ ID NO: 6267 - DNA, 50 bp, Artificial Sequence; identical to SEQ ID NO: 6076
  synthetic Elaeis guineensis (oil palm) single nucleotide polymorphism (SNP) in genomic region adjacent to shatterproof1 (SHELL) shell thickness gene

SEQ ID NO: 6268 - DNA, 50 bp, Artificial Sequence
  synthetic Elaeis guineensis (oil palm) single nucleotide polymorphism (SNP) in genomic region adjacent to shatterproof1 (SHELL) shell thickness gene
taatctatctctttgaatcggactkgcaccagaaagacttcgaaatttga

SEQ ID NO: 6269 - DNA, 50 bp, Artificial Sequence; identical to SEQ ID NO: 6084
  synthetic Elaeis guineensis (oil palm) single nucleotide polymorphism (SNP) in genomic region adjacent to shatterproof1 (SHELL) shell thickness gene

SEQ ID NO: 6270 - DNA, 50 bp, Artificial Sequence; identical to SEQ ID NO: 6082
  synthetic Elaeis guineensis (oil palm) single nucleotide polymorphism (SNP) in genomic region adjacent to shatterproof1 (SHELL) shell thickness gene

SEQ ID NO: 6271 - DNA, 50 bp, Artificial Sequence
  synthetic Elaeis guineensis (oil palm) single nucleotide polymorphism (SNP) in genomic region adjacent to shatterproof1 (SHELL) shell thickness gene
atggataatgtactaaataattttmtttctcataatgtttaggtgatgaa

SEQ ID NO: 6272 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctactctacctttgaaatagggcyatatggataatgtactaaataattt

SEQ ID NO: 6273 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttccttttccttttcaaggaaatakgatgggcatatgcctgctcgaactc

SEQ ID NO: 6274 - DNA, 50 bp, Artificial Sequence
  synthetic Elaeis guineensis (oil palm) single nucleotide polymorphism (SNP) in genomic region adjacent to shatterproof1 (SHELL) shell thickness gene
tagaactcgtttttgtaaagttctrccactcataataatgatttattacc

SEQ ID NO: 6275 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttagtgccttaccatattaatgtsttaatttcttagtattttgttttga

SEQ ID NO: 6276 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttattagcatgaagagggatattgygaaaggccctctttcccaagattca

SEQ ID NO: 6277 - DNA, 50 bp, Artificial Sequence
  synthetic Elaeis guineensis (oil palm) single nucleotide polymorphism (SNP) in genomic region adjacent to shatterproof1 (SHELL) shell thickness gene
atcttctttatgctttgaccctggygacaatatctgataaaactagtctc

SEQ ID NO: 6278 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcagagtagcagccagcaggctgcwgttgtgtcgtatgatggactcaagc

SEQ ID NO: 6279 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttgaagcattacctacttcagatkgccaaaatactcttttatttttctt

SEQ ID NO: 6280 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaaggctaatcaatcacagacaawtgaatttgcctgctgttccctcttc

SEQ ID NO: 6281 - DNA, 50 bp, Artificial Sequence
  synthetic Elaeis guineensis (oil palm) single nucleotide polymorphism (SNP) in genomic region adjacent to shatterproof1 (SHELL) shell thickness gene
catggccaatcatgtcatgccactwgtgcccaccacacatgcacagcaag

SEQ ID NO: 6282 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatggtcatcacaagcagattccarccgacttgattttgttacttatcca

SEQ ID NO: 6283 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaatcctgcacttcctctctaacyagatcttccaccatatggtcatcac

SEQ ID NO: 6284 - DNA, 50 bp, Artificial Sequence
  synthetic Elaeis guineensis (oil palm) single nucleotide polymorphism (SNP) in genomic region adjacent to shatterproof1 (SHELL) shell thickness gene
caaattttagtttgttccattaaarcctcagtgtgatgagaagtagtttc

SEQ ID NO: 6285 - DNA, 50 bp, Artificial Sequence
  synthetic Elaeis guineensis (oil palm) single nucleotide polymorphism (SNP) in genomic region adjacent to shatterproof1 (SHELL) shell thickness gene
catttcattgagagattgaattatkaaaatgaacaagactaacgccagcc

SEQ ID NO: 6286 - DNA, 50 bp, Artificial Sequence
  synthetic Elaeis guineensis (oil palm) single nucleotide polymorphism (SNP) in genomic region adjacent to shatterproof1 (SHELL) shell thickness gene
cttcatttcattgagagattgaatyattaaaatgaacaagactaacgcca

SEQ ID NO: 6287 - DNA, 50 bp, Artificial Sequence
  synthetic Elaeis guineensis (oil palm) single nucleotide polymorphism (SNP) in genomic region adjacent to shatterproof1 (SHELL) shell thickness gene
gacttctcaaatgcagtaatgtagscaatttttatggtttctgaccatgc

SEQ ID NO: 6288 - DNA, 50 bp, Artificial Sequence
  synthetic Elaeis guineensis (oil palm) single nucleotide polymorphism (SNP) in genomic region adjacent to shatterproof1 (SHELL) shell thickness gene
gagatcggaaatgatcgattacttkagctatgtttttcgaattgaaattc

SEQ ID NO: 6289 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttttcattcaccttcctcttctcmctcgtatctacatttgcaacctcaa

SEQ ID NO: 6290 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtatgtcgtagttgtgattatatckaaatggatttagatccttagcctca

SEQ ID NO: 6291 - DNA, 50 bp, Artificial Sequence
  synthetic Elaeis guineensis (oil palm) single nucleotide polymorphism (SNP) in genomic region adjacent to shatterproof1 (SHELL) shell thickness gene
gagcaaatccccagatcaagtgcascataaggttgacacatcccagtagt

SEQ ID NO: 6292 - DNA, 50 bp, Artificial Sequence
  synthetic Elaeis guineensis (oil palm) single nucleotide polymorphism (SNP) in genomic region adjacent to shatterproof1 (SHELL) shell thickness gene
atgctaggagcaaatccccagatcragtgcagcataaggttgacacatcc

SEQ ID NO: 6293 - DNA, 50 bp, Artificial Sequence
  synthetic Elaeis guineensis (oil palm) single nucleotide polymorphism (SNP) in genomic region adjacent to shatterproof1 (SHELL) shell thickness gene
agggcccctggttgatcaccaactwggtgctagtgcatgaaccctcatgg

SEQ ID NO: 6294 - DNA, 50 bp, Artificial Sequence
  synthetic Elaeis guineensis (oil palm) single nucleotide polymorphism (SNP) in genomic region adjacent to shatterproof1 (SHELL) shell thickness gene
cagtcaaactaatgaaagctggatwcacaccaattgtatctggctataat

SEQ ID NO: 6295 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtggacttgggtgctagcatgcagragcaaccactcaaaacaatctagaa

SEQ ID NO: 6296 - DNA, 50 bp, Artificial Sequence
  synthetic Elaeis guineensis (oil palm) single nucleotide polymorphism (SNP) in genomic region adjacent to shatterproof1 (SHELL) shell thickness gene
atatgcctatttgattaaatatacyttagatgtcaaaagggggagcaagt

SEQ ID NO: 6297 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaaaaagaaacaattcatctatatkgcatatacacatagttttcattcag

SEQ ID NO: 6298 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcttagacaattgatagtcaaaatyttgaaaaagaaacaattcatctata

SEQ ID NO: 6299 - DNA, 50 bp, Artificial Sequence
  synthetic Elaeis guineensis (oil palm) single nucleotide polymorphism (SNP) in genomic region adjacent to shatterproof1 (SHELL) shell thickness gene
atttcaccatttaccaattgcataygaaatctaggaaaattaaaataatg

SEQ ID NO: 6300 - DNA, 50 bp, Artificial Sequence
  synthetic Elaeis guineensis (oil palm) single nucleotide polymorphism (SNP) in genomic region adjacent to shatterproof1 (SHELL) shell thickness gene
atttgatccaagttatggagttttkgtcacaaaattaaagaaatatgcca

SEQ ID NO: 6301 - DNA, 50 bp, Artificial Sequence
  synthetic Elaeis guineensis (oil palm) single nucleotide polymorphism (SNP) in genomic region adjacent to shatterproof1 (SHELL) shell thickness gene
cccaccatatttgatccaagttatrgagtttttgtcacaaaattaaagaa

SEQ ID NO: 6302 - DNA, 50 bp, Artificial Sequence
  synthetic Elaeis guineensis (oil palm) single nucleotide polymorphism (SNP) in genomic region adjacent to shatterproof1 (SHELL) shell thickness gene
aggtttagccagtccttagtggatsaccatgaatgtttgaaagctcagtt

SEQ ID NO: 6303 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgtctaaaatcttgaaggacctagrtttagccagtccttagtggatgacc

SEQ ID NO: 6304 - DNA, 50 bp, Artificial Sequence
  synthetic Elaeis guineensis (oil palm) single nucleotide polymorphism (SNP) in genomic region adjacent to shatterproof1 (SHELL) shell thickness gene
agggaatgaaagtaagagagagagrgagagagagagattcaagctagctg

SEQ ID NO: 6305 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatagataattggttcaacttcttrtcaagaggatatgtcctccatgggt

SEQ ID NO: 6306 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctaaagtctaaacttctcttaccrataaaggtgaaccaaaataccatgt

SEQ ID NO: 6307 - DNA, 50 bp, Artificial Sequence
  synthetic Elaeis guineensis (oil palm) single nucleotide polymorphism (SNP) in genomic region adjacent to shatterproof1 (SHELL) shell thickness gene
attggaatattcgtaaagaaagaakgcaactggccagtaactgaagagac

SEQ ID NO: 6308 - DNA, 50 bp, Artificial Sequence
  synthetic Elaeis guineensis (oil palm) single nucleotide polymorphism (SNP) in genomic region adjacent to shatterproof1 (SHELL) shell thickness gene
agttctctccatacatcttctactyttggctccacatagtattactgata

SEQ ID NO: 6309 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaatatatctagaatctaggcacmtaaagttctctccatacatcttcta

SEQ ID NO: 6310 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctatttatatatatagtcttagcrgaaatgaatgatctctcaaaatgaa

SEQ ID NO: 6311 - DNA, 50 bp, Artificial Sequence
  synthetic Elaeis guineensis (oil palm) single nucleotide polymorphism (SNP) in genomic region adjacent to shatterproof1 (SHELL) shell thickness gene
atttttagtgatatatattatgacraaaagtggatctttgagttagatgc

SEQ ID NO: 6312 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttttgatttctagatatttttagtratatatattatgacgaaaagtggat

SEQ ID NO: 6313 - DNA, 50 bp, Artificial Sequence
  synthetic Elaeis guineensis (oil palm) single nucleotide polymorphism (SNP) in genomic region adjacent to shatterproof1 (SHELL) shell thickness gene
agattattaaaacacttgatttttkatttctagatatttttagtgatata

SEQ ID NO: 6314 - DNA, 50 bp, Artificial Sequence
  synthetic Elaeis guineensis (oil palm) single nucleotide polymorphism (SNP) in genomic region adjacent to shatterproof1 (SHELL) shell thickness gene
atgatctcatattatcttaaccctycatttttgcactcactagatgcatg

SEQ ID NO: 6315 - DNA, 50 bp, Artificial Sequence
  synthetic Elaeis guineensis (oil palm) single nucleotide polymorphism (SNP) in genomic region adjacent to shatterproof1 (SHELL) shell thickness gene
taacaaaatatgatctcatattatsttaacccttcatttttgcactcact

SEQ ID NO: 6316 - DNA, 50 bp, Artificial Sequence
  synthetic Elaeis guineensis (oil palm) single nucleotide polymorphism (SNP) in genomic region adjacent to shatterproof1 (SHELL) shell thickness gene
attaattagtaacccatatataccrtatcggcacaaaaaatgaaatagtt

SEQ ID NO: 6317 - DNA, 50 bp, Artificial Sequence
  synthetic Elaeis guineensis (oil palm) single nucleotide polymorphism (SNP) in genomic region adjacent to shatterproof1 (SHELL) shell thickness gene
atactgaaaggggcaaaatccttcytatgtacatgagatagctttgctcc

SEQ ID NO: 6318 - DNA, 50 bp, Artificial Sequence
  synthetic Elaeis guineensis (oil palm) single nucleotide polymorphism (SNP) in genomic region adjacent to shatterproof1 (SHELL) shell thickness gene
cacatgttttcggagccgggcaccraggttttatccataacatatgaatc

SEQ ID NO: 6319 - DNA, 50 bp, Artificial Sequence
  synthetic Elaeis guineensis (oil palm) single nucleotide polymorphism (SNP) in genomic region adjacent to shatterproof1 (SHELL) shell thickness gene
gagagagagcttttgtgaagaaaawttttttgtgagggagagattgggtg

SEQ ID NO: 6320 - DNA, 50 bp, Artificial Sequence
  synthetic Elaeis guineensis (oil palm) single nucleotide polymorphism (SNP) in genomic region adjacent to shatterproof1 (SHELL) shell thickness gene
agcatgcacaggtacggcccatgcractttcaatggcccatcgatggtcc

SEQ ID NO: 6321 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggtgtgacaagttgggacatctagycagagattgctctcaactcagggat

SEQ ID NO: 6322 - DNA, 50 bp, Artificial Sequence
  synthetic Elaeis guineensis (oil palm) single nucleotide polymorphism (SNP) in genomic region adjacent to shatterproof1 (SHELL) shell thickness gene
aggagatggtagacagagcgatagragatcacgatggggggttcaggtcc

SEQ ID NO: 6323 - DNA, 50 bp, Artificial Sequence
  synthetic Elaeis guineensis (oil palm) single nucleotide polymorphism (SNP) in genomic region adjacent to shatterproof1 (SHELL) shell thickness gene
agtaggagatggtagacagagcgayaggagatcacgatggggggttcagg

SEQ ID NO: 6324 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttttttctttctgctgcgatgcgtkgtatcaaaaaagtcttgtggaggtg

SEQ ID NO: 6325 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttttatttttttttctttctgctgygatgcgtggtatcaaaaaagtcttg

SEQ ID NO: 6326 - DNA, 50 bp, Artificial Sequence
  synthetic Elaeis guineensis (oil palm) single nucleotide polymorphism (SNP) in genomic region adjacent to shatterproof1 (SHELL) shell thickness gene
acaggtatggtggttctgtagagayctgaaatcgtggagtagaggatagc

SEQ ID NO: 6327 - DNA, 50 bp, Artificial Sequence
  synthetic Elaeis guineensis (oil palm) single nucleotide polymorphism (SNP) in genomic region adjacent to shatterproof1 (SHELL) shell thickness gene
aactcatcctgtggcaacagagacrggtatggtggttctgtagagacctg

SEQ ID NO: 6328 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggatgttttgggctgatttttcacrgtctacaaagattttcatggatcga

SEQ ID NO: 6329 - DNA, 50 bp, Artificial Sequence
  synthetic Elaeis guineensis (oil palm) single nucleotide polymorphism (SNP) in genomic region adjacent to shatterproof1 (SHELL) shell thickness gene
tccatcatggatcgaaggatgtttygggctgatttttcacagtctacaaa

SEQ ID NO: 6330 - DNA, 50 bp, Artificial Sequence
  synthetic Elaeis guineensis (oil palm) single nucleotide polymorphism (SNP) in genomic region adjacent to shatterproof1 (SHELL) shell thickness gene
gggtgggcattttttcttagtttcrcacagtccatcatggatcgaaggat

SEQ ID NO: 6331 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatgagcccaagatcagtccaaacrgagatcggatgaaaaagatatgcta

SEQ ID NO: 6332 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaataggattgactacatttgtaayagattggatatgattaatatctatg

SEQ ID NO: 6333 - DNA, 50 bp, Artificial Sequence
  synthetic Elaeis guineensis (oil palm) single nucleotide polymorphism (SNP) in genomic region adjacent to shatterproof1 (SHELL) shell thickness gene
actaaggctctaaaccggaataggrttgactacatttgtaatagattgga

SEQ ID NO: 6334 - DNA, 50 bp, Artificial Sequence
  synthetic Elaeis guineensis (oil palm) single nucleotide polymorphism (SNP) in genomic region adjacent to shatterproof1 (SHELL) shell thickness gene
attaaaggataaagtatattgaagytgattgtcactttgttcgtgagaag

SEQ ID NO: 6335 - DNA, 50 bp, Artificial Sequence
  synthetic Elaeis guineensis (oil palm) single nucleotide polymorphism (SNP) in genomic region adjacent to shatterproof1 (SHELL) shell thickness gene
gatgagcttgttttcaaaagtactstgcctatgagactgtgatgtgataa

SEQ ID NO: 6336 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttatattttttcctcgaactactyactgggaggcagttctgtatatatt

SEQ ID NO: 6337 - DNA, 50 bp, Artificial Sequence
  synthetic Elaeis guineensis (oil palm) single nucleotide polymorphism (SNP) in genomic region adjacent to shatterproof1 (SHELL) shell thickness gene
cataaagatacagaaagttgatcgrtaagcttaattatcttacagtcact

SEQ ID NO: 6338 - DNA, 50 bp, Artificial Sequence
  synthetic Elaeis guineensis (oil palm) single nucleotide polymorphism (SNP) in genomic region adjacent to shatterproof1 (SHELL) shell thickness gene
attgtgcatgtggatgatattgtarctagtcacaggaagtgatgatactg

SEQ ID NO: 6339 - DNA, 50 bp, Artificial Sequence
  synthetic Elaeis guineensis (oil palm) single nucleotide polymorphism (SNP) in genomic region adjacent to shatterproof1 (SHELL) shell thickness gene
cttatttagatgggtcaattccatyttgactcacacaccgactttgtaag

SEQ ID NO: 6340 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttttactgccaatctaaaaaaaatyatctacattgtatttcaacttttta

SEQ ID NO: 6341 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttcaattaaatttgatccaaatctyaatgctcaatcaaatttaattaatt

SEQ ID NO: 6342 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttagaaactacctaattaggatcrtatgacataaataaatgcaacatct

SEQ ID NO: 6343 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttataaattatcatacaatcaactraaaattaatttcaaatctaacatac

SEQ ID NO: 6344 - DNA, 50 bp, Artificial Sequence
  synthetic Elaeis guineensis (oil palm) single nucleotide polymorphism (SNP) in genomic region adjacent to shatterproof1 (SHELL) shell thickness gene
tggactgatatagattgggattcgrtatttaaaaataattttaaatttta

SEQ ID NO: 6345 - DNA, 50 bp, Artificial Sequence
  synthetic Elaeis guineensis (oil palm) single nucleotide polymorphism (SNP) in genomic region adjacent to shatterproof1 (SHELL) shell thickness gene
atctaacaatcgaatgatcaggccygagtgtagcttggccaacctaacca

SEQ ID NO: 6346 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccatcaatttaacaatatctaatartgatcggagcgataaagtggtggcc

SEQ ID NO: 6347 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgtaggctttgtcattctataatgrgtaagaaatgagatgtaggattttg

SEQ ID NO: 6348 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttgaaacagatttttcatctccaayattaagaaatttttcgccttcttca

SEQ ID NO: 6349 - DNA, 50 bp, Artificial Sequence
  synthetic Elaeis guineensis (oil palm) single nucleotide polymorphism (SNP) in genomic region adjacent to shatterproof1 (SHELL) shell thickness gene
cacaatcattgacttcgaagatttyctcttgagtcaatcgatttattctg

SEQ ID NO: 6350 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggtattagtttcttcctcaagaaayttctttttcaaaaagactgtcctat

SEQ ID NO: 6351 - DNA, 50 bp, Artificial Sequence
  synthetic Elaeis guineensis (oil palm) single nucleotide polymorphism (SNP) in genomic region adjacent to shatterproof1 (SHELL) shell thickness gene
gatttgatctaatcaaatccgactytatagatttactatattatgccggt

SEQ ID NO: 6352 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcttcatcctaaatatgtaggatgmttcttctaaattcttcatagagaac

SEQ ID NO: 6353 - DNA, 50 bp, Artificial Sequence
  synthetic Elaeis guineensis (oil palm) single nucleotide polymorphism (SNP) in genomic region adjacent to shatterproof1 (SHELL) shell thickness gene
agttaccatgatgatctcagatcgragaaacacttatacccatatccttc

SEQ ID NO: 6354 - DNA, 50 bp, Artificial Sequence
  synthetic Elaeis guineensis (oil palm) single nucleotide polymorphism (SNP) in genomic region adjacent to shatterproof1 (SHELL) shell thickness gene
caatctaatcactaatcaatccttyaataattcatcaactattagtaaat

SEQ ID NO: 6355 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctcattcaaattcaaagggaatcaraaagtgagtgtcaatcctcttctgg

SEQ ID NO: 6356 - DNA, 50 bp, Artificial Sequence
  synthetic Elaeis guineensis (oil palm) single nucleotide polymorphism (SNP) in genomic region adjacent to shatterproof1 (SHELL) shell thickness gene
tccctctcagaaatgattttccacrataaagactctctttttgtcgcaca

SEQ ID NO: 6357 - DNA, 50 bp, Artificial Sequence
  synthetic Elaeis guineensis (oil palm) single nucleotide polymorphism (SNP) in genomic region adjacent to shatterproof1 (SHELL) shell thickness gene
gggagtgctagctcgcacgaaagayactggatggttgatttatgctcttt

SEQ ID NO: 6358 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaaagaaaaatcgatggttcaaagyatgcattttcaaaattttttagcga

SEQ ID NO: 6359 - DNA, 50 bp, Artificial Sequence
  synthetic Elaeis guineensis (oil palm) single nucleotide polymorphism (SNP) in genomic region adjacent to shatterproof1 (SHELL) shell thickness gene
tggggatcttgttccatcgagtctragtctgattttagatgctttattac

SEQ ID NO: 6360 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttttgaaattattcattctaatgtytggggatcttgttccatcgagtcta

SEQ ID NO: 6361 - DNA, 50 bp, Artificial Sequence
  synthetic Elaeis guineensis (oil palm) single nucleotide polymorphism (SNP) in genomic region adjacent to shatterproof1 (SHELL) shell thickness gene
tagaggtcatgagtccaaaaggctrtacactcttgagattatgtctgatt

SEQ ID NO: 6362 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatgttagtaagattactcatgctstcaactgtaatgttcacttctttcc

SEQ ID NO: 6363 - DNA, 50 bp, Artificial Sequence
  synthetic Elaeis guineensis (oil palm) single nucleotide polymorphism (SNP) in genomic region adjacent to shatterproof1 (SHELL) shell thickness gene
tacttgccccatgccttctcttttyttaagttctgttctgtacttatctc

SEQ ID NO: 6364 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctattacttgtctcacctcttcctyatgcaattgggtcattgattcaggt

SEQ ID NO: 6365 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctttattcggtcaggtaaatctaytacttgtctcacctcttcctcatgc

SEQ ID NO: 6366 - DNA, 50 bp, Artificial Sequence
  synthetic Elaeis guineensis (oil palm) single nucleotide polymorphism (SNP) in genomic region adjacent to shatterproof1 (SHELL) shell thickness gene
gatcgacttttaagatccctctttyctccttctgtagtgcatgacccttt

SEQ ID NO: 6367 - DNA, 50 bp, Artificial Sequence
  synthetic Elaeis guineensis (oil palm) single nucleotide polymorphism (SNP) in genomic region adjacent to shatterproof1 (SHELL) shell thickness gene
gagatcaattatggtatacattatrgtgtatatttctgtttaagaaatat

SEQ ID NO: 6368 - DNA, 50 bp, Artificial Sequence
  synthetic Elaeis guineensis (oil palm) single nucleotide polymorphism (SNP) in genomic region adjacent to shatterproof1 (SHELL) shell thickness gene
taatcttttcttctcaaatcacccyacaacccactgatgagatatctatc

SEQ ID NO: 6369 - DNA, 50 bp, Artificial Sequence
  synthetic Elaeis guineensis (oil palm) single nucleotide polymorphism (SNP) in genomic region adjacent to shatterproof1 (SHELL) shell thickness gene
atagattttataacttagattattragaaaatagtctcacattattttaa

SEQ ID NO: 6370 - DNA, 50 bp, Artificial Sequence
  synthetic Elaeis guineensis (oil palm) single nucleotide polymorphism (SNP) in genomic region adjacent to shatterproof1 (SHELL) shell thickness gene
cttcgtacatcaaagcatacaacakcatatctctccctgcctaatcaatc

SEQ ID NO: 6371 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttaagaggatgtatcgaagccttcrtacatcaaagcatacaacagcatat

SEQ ID NO: 6372 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaatatgtggaaatgatctagaccwcagagtaagaatgtaaactaatttc

SEQ ID NO: 6373 - DNA, 50 bp, Artificial Sequence
  synthetic Elaeis guineensis (oil palm) single nucleotide polymorphism (SNP) in genomic region adjacent to shatterproof1 (SHELL) shell thickness gene
catccaatttcagaatccaaattgyggaatatgtggaaatgatctagacc

SEQ ID NO: 6374 - DNA, 50 bp, Artificial Sequence
  synthetic Elaeis guineensis (oil palm) single nucleotide polymorphism (SNP) in genomic region adjacent to shatterproof1 (SHELL) shell thickness gene
aggacccatgcacacacatatatayagtacaggcataaatacatacatat

SEQ ID NO: 6375 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttattaaaataaactctggtcgatratacccccaacctctttagttatat

SEQ ID NO: 6376 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcaagtgctaaatcaaaaaagtgaktttatttattaaaataaactctggt

SEQ ID NO: 6377 - DNA, 50 bp, Artificial Sequence
  synthetic Elaeis guineensis (oil palm) single nucleotide polymorphism (SNP) in genomic region adjacent to shatterproof1 (SHELL) shell thickness gene
taatcaatcttgctaaatatcactrgctcttggcatgtacaatgtggcta

SEQ ID NO: 6378 - DNA, 50 bp, Artificial Sequence
  synthetic Elaeis guineensis (oil palm) single nucleotide polymorphism (SNP) in genomic region adjacent to shatterproof1 (SHELL) shell thickness gene
gatctcttcttgtaatttttttttyatagtgaagcttgcatgccccatag

SEQ ID NO: 6379 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggcggcagagggccaatagaaatckatggtggcacagctaggccgggtag

SEQ ID NO: 6380 - DNA, 50 bp, Artificial Sequence
  synthetic Elaeis guineensis (oil palm) single nucleotide polymorphism (SNP) in genomic region adjacent to shatterproof1 (SHELL) shell thickness gene
tggcctgacttgactttcatatttrtccatccttgatcaataggtgattg

SEQ ID NO: 6381 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttaggagccagaaggagcccagaaygaggtggagctctagatagaggtgg

SEQ ID NO: 6382 - DNA, 50 bp, Artificial Sequence
  synthetic Elaeis guineensis (oil palm) single nucleotide polymorphism (SNP) in genomic region adjacent to shatterproof1 (SHELL) shell thickness gene
aattttagattctgcatgcacctakcatgtatgttataaaaaagagcagt

SEQ ID NO: 6383 - DNA, 50 bp, Artificial Sequence
  synthetic Elaeis guineensis (oil palm) single nucleotide polymorphism (SNP) in genomic region adjacent to shatterproof1 (SHELL) shell thickness gene
ataatgaagcttgcatgccccataraggcgagctttttgactgatccacg

SEQ ID NO: 6384 - DNA, 50 bp, Artificial Sequence
  synthetic Elaeis guineensis (oil palm) single nucleotide polymorphism (SNP) in genomic region adjacent to shatterproof1 (SHELL) shell thickness gene
gagtatgagaaaaactcgaaaataratggcacagcccacagagtggaata

SEQ ID NO: 6385 - DNA, 50 bp, Artificial Sequence
  synthetic Elaeis guineensis (oil palm) single nucleotide polymorphism (SNP) in genomic region adjacent to shatterproof1 (SHELL) shell thickness gene
atgataaatggagtatgagaaaaayggccgacaggggcatatgatcttct

SEQ ID NO: 6386 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaccctcagtggtgctgaaataggyccaggatgataaatggagtatgaga

SEQ ID NO: 6387 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaggagatacgcagcccacagaacsgtgaaggccgacaggggcatctgat

SEQ ID NO: 6388 - DNA, 50 bp, Artificial Sequence
  synthetic Elaeis guineensis (oil palm) single nucleotide polymorphism (SNP) in genomic region adjacent to shatterproof1 (SHELL) shell thickness gene
cccaggtttgaatcacgaaagcacrgattaaatatcaagatacgggggtt

SEQ ID NO: 6389 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgggctatgaacagggaaaaaatakaacagtctctattaattctgtcata

SEQ ID NO: 6390 - DNA, 50 bp, Artificial Sequence
  synthetic Elaeis guineensis (oil palm) single nucleotide polymorphism (SNP) in genomic region adjacent to shatterproof1 (SHELL) shell thickness gene
agatggcagggacagagatggaccraggggatttaactaatccagtgttt

SEQ ID NO: 6391 - DNA, 50 bp, Artificial Sequence
  synthetic Elaeis guineensis (oil palm) single nucleotide polymorphism (SNP) in genomic region adjacent to shatterproof1 (SHELL) shell thickness gene
acattgtcaaagatggcagggacakagatggaccaaggggatttaactaa

SEQ ID NO: 6392 - DNA, 50 bp, Artificial Sequence
  synthetic Elaeis guineensis (oil palm) single nucleotide polymorphism (SNP) in genomic region adjacent to shatterproof1 (SHELL) shell thickness gene
caccttacatcattggcaagaattygagggaggggaaggagattaggccc

SEQ ID NO: 6393 - DNA, 50 bp, Artificial Sequence
  synthetic Elaeis guineensis (oil palm) single nucleotide polymorphism (SNP) in genomic region adjacent to shatterproof1 (SHELL) shell thickness gene
atggttgtgataagcatttggtggyttgatttcaaagcattacaaaattg

SEQ ID NO: 6394 - DNA, 50 bp, Artificial Sequence
  synthetic Elaeis guineensis (oil palm) single nucleotide polymorphism (SNP) in genomic region adjacent to shatterproof1 (SHELL) shell thickness gene
acccatcgtatagagataatcatgyccagtgattcctaaatctgaaaata

SEQ ID NO: 6395 - DNA, 50 bp, Artificial Sequence
  synthetic Elaeis guineensis (oil palm) single nucleotide polymorphism (SNP) in genomic region adjacent to shatterproof1 (SHELL) shell thickness gene
tacattctttcatatttcaccaaayaaatgaattcctcatccatccttcc

SEQ ID NO: 6396 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcatacaaatattgtttgtcctttyttttatttttttatattaaatagaa

SEQ ID NO: 6397 - DNA, 50 bp, Artificial Sequence
  synthetic Elaeis guineensis (oil palm) single nucleotide polymorphism (SNP) in genomic region adjacent to shatterproof1 (SHELL) shell thickness gene
aataaattaatttattaaatttatwaaattatttattaaattaaattaaa

SEQ ID NO: 6398 - DNA, 50 bp, Artificial Sequence
  synthetic Elaeis guineensis (oil palm) single nucleotide polymorphism (SNP) in genomic region adjacent to shatterproof1 (SHELL) shell thickness gene
aattgatatataaataaattaattyattaaatttattaaattatttatta

SEQ ID NO: 6399 - DNA, 50 bp, Artificial Sequence
  synthetic Elaeis guineensis (oil palm) single nucleotide polymorphism (SNP) in genomic region adjacent to shatterproof1 (SHELL) shell thickness gene
atattttttatttatctttaatttmtgtatatcatttccataactatgat

SEQ ID NO: 6400 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttttcattcatattatttatattytttatttatctttaatttctgtata

SEQ ID NO: 6401 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcatccatgtctagttaaggttatragagggaagatgaatgggattgtaa

SEQ ID NO: 6402 - DNA, 50 bp, Artificial Sequence
  synthetic Elaeis guineensis (oil palm) single nucleotide polymorphism (SNP) in genomic region adjacent to shatterproof1 (SHELL) shell thickness gene
cggcttctatgactttttgcctcayctttaattctcataaaaattctgag

SEQ ID NO: 6403 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggaaggacctctctaatcttttaaycggcttctatgactttttgcctcac

SEQ ID NO: 6404 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttagctgaactaatatattcatttyattattgttatatattttcatacta

SEQ ID NO: 6405 - DNA, 50 bp, Artificial Sequence
  synthetic Elaeis guineensis (oil palm) single nucleotide polymorphism (SNP) in genomic region adjacent to shatterproof1 (SHELL) shell thickness gene
acagagtgagtattcataaatgtawatttcttgataagagaactcgtgaa

SEQ ID NO: 6406 - DNA, 50 bp, Artificial Sequence
  synthetic Elaeis guineensis (oil palm) single nucleotide polymorphism (SNP) in genomic region adjacent to shatterproof1 (SHELL) shell thickness gene
aataaaaacccgttccactgggatrccaccttaatggtaacagagtgagt

SEQ ID NO: 6407 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcattcgcatcttggtatttaatcrcagtccgatatccgtcgtgattcga

SEQ ID NO: 6408 - DNA, 50 bp, Artificial Sequence
  synthetic Elaeis guineensis (oil palm) single nucleotide polymorphism (SNP) in genomic region adjacent to shatterproof1 (SHELL) shell thickness gene
tggaccagatgctgtttccagacgycatgtccgagccgtcaggatatgct

SEQ ID NO: 6409 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttgcaaggcctatctttgaaagayggattagggtataagttaacaaatc

SEQ ID NO: 6410 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatacgcatttaatatctgcagatygattttttcgtttaaaaatttttga

SEQ ID NO: 6411 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttattcaaatatttttcaatacgyatttaatatctgcagattgattttt

SEQ ID NO: 6412 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttttttaattatgatattctatgayatattataatctaatatgtcataat

SEQ ID NO: 6413 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttcgattgatttatgttgttattaktttttaacatatatttaatattttt

SEQ ID NO: 6414 - DNA, 50 bp, Artificial Sequence
  synthetic Elaeis guineensis (oil palm) single nucleotide polymorphism (SNP) in genomic region adjacent to shatterproof1 (SHELL) shell thickness gene
cacgtgtggaaaagcgaatccactscgggcccaggaaattgactgtgggc

SEQ ID NO: 6415 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgattgacatgatgtatggtacatrtgatatgcggtacaggatatcttct

SEQ ID NO: 6416 - DNA, 50 bp, Artificial Sequence
  synthetic Elaeis guineensis (oil palm) single nucleotide polymorphism (SNP) in genomic region adjacent to shatterproof1 (SHELL) shell thickness gene
atgagtgcatacagtcatacgatcmagataaaatgattgacatgatgtat

SEQ ID NO: 6417 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcttcttcacgtggatcaattatcragatgagtgcatacagtcatacgat

SEQ ID NO: 6418 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttcataaaaaaaaaatagatcaacrgtatagaatagagcaaaataatatc

SEQ ID NO: 6419 - DNA, 50 bp, Artificial Sequence
  synthetic Elaeis guineensis (oil palm) single nucleotide polymorphism (SNP) in genomic region adjacent to shatterproof1 (SHELL) shell thickness gene
caattcaatatgttatattatacawcatctcccctaccaatccaaccttc

SEQ ID NO: 6420 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgccgacaaatcatgcacaccatgycccttgagggtgctctctccgaaaa

SEQ ID NO: 6421 - DNA, 50 bp, Artificial Sequence
  synthetic Elaeis guineensis (oil palm) single nucleotide polymorphism (SNP) in genomic region adjacent to shatterproof1 (SHELL) shell thickness gene
atcaggctactccaatggctacctycctttttttccacactaaaatctgc

SEQ ID NO: 6422 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttcacgattgctgcactcccgcgtmgatatcttgcagaagattccgatgg

SEQ ID NO: 6423 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaccactcaaaactatgaaaacaaygtcattttccatccaagtgtctttg

SEQ ID NO: 6424 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgaatatatccttaaaattttcagstgatgatgtacaaaaaataaataaa

SEQ ID NO: 6425 - DNA, 50 bp, Artificial Sequence
  synthetic Elaeis guineensis (oil palm) single nucleotide polymorphism (SNP) in genomic region adjacent to shatterproof1 (SHELL) shell thickness gene
tattgaaaactgcataccaatatamggagtgcagtcctaaattttatagt

SEQ ID NO: 6426 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgcaatacacagaagctattcatawattggtgatcagctttgtgactaag

SEQ ID NO: 6427 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctaacgcaatgtgctcgaaatagcytattaatgcatttgtgattattgag

SEQ ID NO: 6428 - DNA, 50 bp, Artificial Sequence
  synthetic Elaeis guineensis (oil palm) single nucleotide polymorphism (SNP) in genomic region adjacent to shatterproof1 (SHELL) shell thickness gene
cccccgtagaactactgcagtcaawaaaagaattatagaacgaactaact

SEQ ID NO: 6429 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttttaaatgcacaaaattctcatgrtggtggtgagaaagaataaaatata

SEQ ID NO: 6430 - DNA, 50 bp, Artificial Sequence
  synthetic Elaeis guineensis (oil palm) single nucleotide polymorphism (SNP) in genomic region adjacent to shatterproof1 (SHELL) shell thickness gene
tactttcttcttgcctttttttttkggggcgataaaatgacggtagagtc

SEQ ID NO: 6431 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttccagcaaatgagatgggcccttyagcattcgaccgaccgttaaccatg

SEQ ID NO: 6432 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgttggcgttttaattttatttccycataaatgattagaagagtacagtt

SEQ ID NO: 6433 - DNA, 50 bp, Artificial Sequence
  synthetic Elaeis guineensis (oil palm) single nucleotide polymorphism (SNP) in genomic region adjacent to shatterproof1 (SHELL) shell thickness gene
atataccaaatcatcaagtgtccaygggaggtggaggacattagaataaa

SEQ ID NO: 6434 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaatgctaattggtgcttatacakttctgcatagctgcttaaattctaa

SEQ ID NO: 6435 - DNA, 50 bp, Artificial Sequence
  synthetic Elaeis guineensis (oil palm) single nucleotide polymorphism (SNP) in genomic region adjacent to shatterproof1 (SHELL) shell thickness gene
ataatctcaaaatataaattttatwcgtcttatactaaatcctttttttt

SEQ ID NO: 6436 - DNA, 50 bp, Artificial Sequence
  synthetic Elaeis guineensis (oil palm) single nucleotide polymorphism (SNP) in genomic region adjacent to shatterproof1 (SHELL) shell thickness gene
gttcacatctttgatacagccattraatgctctagcagcagtaaccgtta

SEQ ID NO: 6437 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatacttttatgttgcttaagaaarctagaaaataagatacccatccgaa

SEQ ID NO: 6438 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccgttgctctcttttgtattggacycgaagcaatccaaccttaccttttc

SEQ ID NO: 6439 - DNA, 50 bp, Artificial Sequence
  synthetic Elaeis guineensis (oil palm) single nucleotide polymorphism (SNP) in genomic region adjacent to shatterproof1 (SHELL) shell thickness gene
gagagagagggagagattctggggytgtgtacctgtttcctaggacggca

SEQ ID NO: 6440 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctgccgaatgcggaaagaaaagagragaaacagaaagaatgtgttgggaa

SEQ ID NO: 6441 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctctttctccgctgtaccaatctkcgcgcaatctaaatctgttcaaaag

SEQ ID NO: 6442 - DNA, 50 bp, Artificial Sequence
  synthetic Elaeis guineensis (oil palm) single nucleotide polymorphism (SNP) in genomic region adjacent to shatterproof1 (SHELL) shell thickness gene
cagagaagaactgctgacatgcacraaatgagggtattaccttccgatgt

SEQ ID NO: 6443 - DNA, 50 bp, Artificial Sequence
  synthetic Elaeis guineensis (oil palm) single nucleotide polymorphism (SNP) in genomic region adjacent to shatterproof1 (SHELL) shell thickness gene
atatacagtataaggtagccttcgwggaagtgcatgttgactgctggaaa

SEQ ID NO: 6444 - DNA, 50 bp, Artificial Sequence
  synthetic Elaeis guineensis (oil palm) single nucleotide polymorphism (SNP) in genomic region adjacent to shatterproof1 (SHELL) shell thickness gene
atgtggaatgagcctacaggagccrgatgcttttaggaaggaatagaccc

SEQ ID NO: 6445 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaacgatcggctgtaaatacatagrgatcggtacttggagcatttagact

SEQ ID NO: 6446 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatcgtcatggttgtccgttgttgrttgataataatcgattgtcgattga

SEQ ID NO: 6447 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaggtccgaatgagcatcggatggkgactctgatatatcgatgatcttca

SEQ ID NO: 6448 - DNA, 50 bp, Artificial Sequence
  synthetic Elaeis guineensis (oil palm) single nucleotide polymorphism (SNP) in genomic region adjacent to shatterproof1 (SHELL) shell thickness gene
taaccgtttataatggttaggttcygcatattccgattttatgtgatcgt

SEQ ID NO: 6449 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttttattgtactaaattatcggaycataatcgtggagttcataggctgt

SEQ ID NO: 6450 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtatggggtgagaatttgccagtgytcatctgttatgtaggtttgagcgt

SEQ ID NO: 6451 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttgagtatggggtgagaatttgccrgtgctcatctgttatgtaggtttga

SEQ ID NO: 6452 - DNA, 50 bp, Artificial Sequence
  synthetic Elaeis guineensis (oil palm) single nucleotide polymorphism (SNP) in genomic region adjacent to shatterproof1 (SHELL) shell thickness gene
cagttgtagtctaggcgattgagtrtggggtgagaatttgccagtgctca

SEQ ID NO: 6453 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggggaccaggtaggcttttgttgcwgaaacaaactgacgatacaatatga

SEQ ID NO: 6454 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttatacatcattgatgttactaacragcgatcaaagagaaggatgcagac

SEQ ID NO: 6455 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctttttccaagttatacatcattratgttactaacgagcgatcaaagag

SEQ ID NO: 6456 - DNA, 50 bp, Artificial Sequence
  synthetic Elaeis guineensis (oil palm) single nucleotide polymorphism (SNP) in genomic region adjacent to shatterproof1 (SHELL) shell thickness gene
gagtgggctatggtctgaatttacrtctgaagttttttctcttgcttttt

SEQ ID NO: 6457 - DNA, 50 bp, Artificial Sequence
  synthetic Elaeis guineensis (oil palm) single nucleotide polymorphism (SNP) in genomic region adjacent to shatterproof1 (SHELL) shell thickness gene
attgattctctgttttgccttcctrtgaaaacctttaacagtggcaccta

SEQ ID NO: 6458 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttatgatgcatggaggcattaacrgtaattgattctctgttttgccttc

SEQ ID NO: 6459 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaatatgtacttgcataagacaatrgtctttgccatatcccttattgctt

SEQ ID NO: 6460 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttatgatgtcaaggaatttcattcmatgaaaattgtaagtaattttggca

SEQ ID NO: 6461 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcgtttcttcttcttcttcttcttytttttgggtaaagggagcataattt

SEQ ID NO: 6462 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaatccatttgttacaaggtttacyggaccaaattttcaggaatgtggta

SEQ ID NO: 6463 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgtttgccaagctgttcctctcatycttggtgatcatccatttgtaccca

SEQ ID NO: 6464 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctgggtgattggagggctttcctcrcacttgtttgcaattatttatggac

SEQ ID NO: 6465 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcattgcccggtatggtatgcatayggtggcaagcttaggttatttgaaa

SEQ ID NO: 6466 - DNA, 50 bp, Artificial Sequence
  synthetic Elaeis guineensis (oil palm) single nucleotide polymorphism (SNP) in genomic region adjacent to shatterproof1 (SHELL) shell thickness gene
catatgttcggctagatagtggccratgggaagcaagggatctttaaaga

SEQ ID NO: 6467 - DNA, 50 bp, Artificial Sequence
  synthetic Elaeis guineensis (oil palm) single nucleotide polymorphism (SNP) in genomic region adjacent to shatterproof1 (SHELL) shell thickness gene
aacatctgcaacacgtgaagatctyctaaaagaagcaattcatgtaataa

SEQ ID NO: 6468 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttttgtaatttgtaatcataacctrtgaaagtcctcgttattttttgcag

SEQ ID NO: 6469 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctttgtggcaattctctggcactcrcctgcgaaaattgtgtttaagtgtc

SEQ ID NO: 6470 - DNA, 50 bp, Artificial Sequence
  synthetic Elaeis guineensis (oil palm) single nucleotide polymorphism (SNP) in genomic region adjacent to shatterproof1 (SHELL) shell thickness gene
atttgcttgcaaattccaaatctgkgcaatgcagtctgttccagataata

SEQ ID NO: 6471 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttctttgagttgcatctactctatrgtgtgtcattttgctgtcaagaaca

SEQ ID NO: 6472 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgcacatattcaatgatttttcatratcaatatctatatagtttttcttt

SEQ ID NO: 6473 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttgtttgatgctcatcctaaattcsgtgcatttaagaaagcttgtatgct

SEQ ID NO: 6474 - DNA, 50 bp, Artificial Sequence
  synthetic Elaeis guineensis (oil palm) single nucleotide polymorphism (SNP) in genomic region adjacent to shatterproof1 (SHELL) shell thickness gene
agatgtatgaagatgttttgattcytgatctggatgtatatgcttgcttg

SEQ ID NO: 6475 - DNA, 50 bp, Artificial Sequence
  synthetic Elaeis guineensis (oil palm) single nucleotide polymorphism (SNP) in genomic region adjacent to shatterproof1 (SHELL) shell thickness gene
tacaaatgggatgtatattctaaaycttaactgcaatcactatgtcaaca

SEQ ID NO: 6476 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcaatttgtgaagtctgtggtatgrgttgatttgatttttgcattttggt

SEQ ID NO: 6477 - DNA, 50 bp, Artificial Sequence
  synthetic Elaeis guineensis (oil palm) single nucleotide polymorphism (SNP) in genomic region adjacent to shatterproof1 (SHELL) shell thickness gene
tagtcccacatcagttgtgcgatarggagatcttgaatttttatatagga

SEQ ID NO: 6478 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttttatattttaaataataaaaatyatttttaaatttaaaaattttaaaa

SEQ ID NO: 6479 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgttatgtgcttcaaataatacttytgaattatctaaaatatattaccac

SEQ ID NO: 6480 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcataaaatacttctgattaatacktttcacaattctaatttctcataat

SEQ ID NO: 6481 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttaatctatgcctctttatcatctrgagtagaggcctgtctctctgaaat

SEQ ID NO: 6482 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgaactcagactctcctcggtggtygcagagttggacctccaatctgtac

SEQ ID NO: 6483 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctgcctcttctgactggctccttratagaggtggtcctcctgaactcag

SEQ ID NO: 6484 - DNA, 50 bp, Artificial Sequence
  synthetic Elaeis guineensis (oil palm) single nucleotide polymorphism (SNP) in genomic region adjacent to shatterproof1 (SHELL) shell thickness gene
gttttgaatccttgctagaaaaagyatgtggattcaaatcatgaatggtg

SEQ ID NO: 6485 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcttataaaaaaaaattcatctttytgaatcttctttattactgtcaaga

SEQ ID NO: 6486 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccatttattcttataaaaaaaaatycatctttttgaatcttctttattac

SEQ ID NO: 6487 - DNA, 50 bp, Artificial Sequence
  synthetic Elaeis guineensis (oil palm) single nucleotide polymorphism (SNP) in genomic region adjacent to shatterproof1 (SHELL) shell thickness gene
tccaactgaatcaatcatctccttyatcagtccaaagatgtaggtggcgt

SEQ ID NO: 6488 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgatgtccaataaatatgcgatcgycgctccatcagcaactcgttgacgg

SEQ ID NO: 6489 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtatccactgtctgttgcactttaygaagcttctcaatattcatcaacac

SEQ ID NO: 6490 - DNA, 50 bp, Artificial Sequence
  synthetic Elaeis guineensis (oil palm) single nucleotide polymorphism (SNP) in genomic region adjacent to shatterproof1 (SHELL) shell thickness gene
gggctgtatccactgtctgttgcaytttacgaagcttctcaatattcatc

SEQ ID NO: 6491 - DNA, 50 bp, Artificial Sequence
  synthetic Elaeis guineensis (oil palm) single nucleotide polymorphism (SNP) in genomic region adjacent to shatterproof1 (SHELL) shell thickness gene
tccggtctcaagatctctccctcartatttttttgcatcaatgatagtac

SEQ ID NO: 6492 - DNA, 50 bp, Artificial Sequence
  synthetic Elaeis guineensis (oil palm) single nucleotide polymorphism (SNP) in genomic region adjacent to shatterproof1 (SHELL) shell thickness gene
cactgacaaacatctgatgcaaggytgctttcttctgtagaaggttatca

SEQ ID NO: 6493 - DNA, 50 bp, Artificial Sequence
  synthetic Elaeis guineensis (oil palm) single nucleotide polymorphism (SNP) in genomic region adjacent to shatterproof1 (SHELL) shell thickness gene
gacttccctcagtaccggccctcgyatatctgctctcttctcactcggca

SEQ ID NO: 6494 - DNA, 50 bp, Artificial Sequence
  synthetic Elaeis guineensis (oil palm) single nucleotide polymorphism (SNP) in genomic region adjacent to shatterproof1 (SHELL) shell thickness gene
cgctgtctgcggtgcgaagcacctyatataatggcttgataaccttcact

SEQ ID NO: 6495 - DNA, 50 bp, Artificial Sequence
  synthetic Elaeis guineensis (oil palm) single nucleotide polymorphism (SNP) in genomic region adjacent to shatterproof1 (SHELL) shell thickness gene
atttgagctttatcttattaatctrtttctttattctctccatcatatga

SEQ ID NO: 6496 - DNA, 50 bp, Artificial Sequence
  synthetic Elaeis guineensis (oil palm) single nucleotide polymorphism (SNP) in genomic region adjacent to shatterproof1 (SHELL) shell thickness gene
taatgttgatgtattcctagacatrtttgagctttatcttattaatctgt

SEQ ID NO: 6497 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatgctgtattggaacttcggattyaaatagtaagctgaaaataaatttt

SEQ ID NO: 6498 - DNA, 50 bp, Artificial Sequence
  synthetic Elaeis guineensis (oil palm) single nucleotide polymorphism (SNP) in genomic region adjacent to shatterproof1 (SHELL) shell thickness gene
agaagctcattatccatatctatcycgaatatgctgtattggaacttcgg

SEQ ID NO: 6499 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgcaatttcagaatcggacaccatyttatatatcatattacggagagcag

SEQ ID NO: 6500 - DNA, 50 bp, Artificial Sequence
  synthetic Elaeis guineensis (oil palm) single nucleotide polymorphism (SNP) in genomic region adjacent to shatterproof1 (SHELL) shell thickness gene
gttaaatactcgcatcttaattgayctaacatacctcttgtagacacata

SEQ ID NO: 6501 - DNA, 50 bp, Artificial Sequence
  synthetic Elaeis guineensis (oil palm) single nucleotide polymorphism (SNP) in genomic region adjacent to shatterproof1 (SHELL) shell thickness gene
actatccaaaatgaatccatcattyagctaccagaatattaaacaaaatt

SEQ ID NO: 6502 - DNA, 50 bp, Artificial Sequence
  synthetic Elaeis guineensis (oil palm) single nucleotide polymorphism (SNP) in genomic region adjacent to shatterproof1 (SHELL) shell thickness gene
ataaggacgaaagtcaatcaattaygctcacacccactagaggagaccgt

SEQ ID NO: 6503 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttgctgtggataaggacgaaagtcratcaattatgctcacacccactaga

SEQ ID NO: 6504 - DNA, 50 bp, Artificial Sequence
  synthetic Elaeis guineensis (oil palm) single nucleotide polymorphism (SNP) in genomic region adjacent to shatterproof1 (SHELL) shell thickness gene
agttccaactcctgctgcttgcctrcaagccatccaatcatcagatcctc

SEQ ID NO: 6505 - DNA, 50 bp, Artificial Sequence
  synthetic Elaeis guineensis (oil palm) single nucleotide polymorphism (SNP) in genomic region adjacent to shatterproof1 (SHELL) shell thickness gene
tggcttatcggctggaatcctatgkggaatatttgtatctgcccactgtc

SEQ ID NO: 6506 - DNA, 50 bp, Artificial Sequence
  synthetic Elaeis guineensis (oil palm) single nucleotide polymorphism (SNP) in genomic region adjacent to shatterproof1 (SHELL) shell thickness gene
cttcctgcttgagatgacctacttygtctcagtatttcttgcttaaatat

SEQ ID NO: 6507 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcattaattgagtcaggtctatacygatatctgccacattacatgactaa

SEQ ID NO: 6508 - DNA, 50 bp, Artificial Sequence
  synthetic Elaeis guineensis (oil palm) single nucleotide polymorphism (SNP) in genomic region adjacent to shatterproof1 (SHELL) shell thickness gene
ataatcaatcgtaccttgaaattcytaagcgaccattaatgatcgctgta

SEQ ID NO: 6509 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggaatttatggaagaatattttccyatggatcttatgcagaaaattagaa

SEQ ID NO: 6510 - DNA, 50 bp, Artificial Sequence
  synthetic Elaeis guineensis (oil palm) single nucleotide polymorphism (SNP) in genomic region adjacent to shatterproof1 (SHELL) shell thickness gene
gataccaattgtagggaatttatgraagaatattttcccatggatcttat

SEQ ID NO: 6511 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctaaaaaatatatcattatttaaaycaaatgtgagagtactaaattcata

SEQ ID NO: 6512 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatcctctaaatcagggatcaactmaaaaatatatcattatttaaaccaa

SEQ ID NO: 6513 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatgggtcactttggtggtcaccayctattgaaatctacaatcctctaaa

SEQ ID NO: 6514 - DNA, 50 bp, Artificial Sequence
  synthetic Elaeis guineensis (oil palm) single nucleotide polymorphism (SNP) in genomic region adjacent to shatterproof1 (SHELL) shell thickness gene
tattaatcgaaacataacttgtctratcctcttaaatactgaacagagga

SEQ ID NO: 6515 - DNA, 50 bp, Artificial Sequence
  synthetic Elaeis guineensis (oil palm) single nucleotide polymorphism (SNP) in genomic region adjacent to shatterproof1 (SHELL) shell thickness gene
attaaccaatcatgctcatgaatgsactcatttatcttgatacaccaata

SEQ ID NO: 6516 - DNA, 50 bp, Artificial Sequence
  synthetic Elaeis guineensis (oil palm) single nucleotide polymorphism (SNP) in genomic region adjacent to shatterproof1 (SHELL) shell thickness gene
actgtgcaaattttaataaatgagycacttcggtggtcaccatctattgc

SEQ ID NO: 6517 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgcaccaatagtaagcaatcaatcmaagattaacatatttgattccatga

SEQ ID NO: 6518 - DNA, 50 bp, Artificial Sequence
  synthetic Elaeis guineensis (oil palm) single nucleotide polymorphism (SNP) in genomic region adjacent to shatterproof1 (SHELL) shell thickness gene
atctatttgtccaacttaatgcacmaatagtaagcaatcaatccaagatt

SEQ ID NO: 6519 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgcaatagttttgcaatgcttctcmatccttttaaaatatcatacagaag

SEQ ID NO: 6520 - DNA, 50 bp, Artificial Sequence
  synthetic Elaeis guineensis (oil palm) single nucleotide polymorphism (SNP) in genomic region adjacent to shatterproof1 (SHELL) shell thickness gene
cacaatcactagtcataaaatattycacttcaaaattataacacataata

SEQ ID NO: 6521 - DNA, 50 bp, Artificial Sequence
  synthetic Elaeis guineensis (oil palm) single nucleotide polymorphism (SNP) in genomic region adjacent to shatterproof1 (SHELL) shell thickness gene
actatcctagactatgcacaatcastagtcataaaatatttcacttcaaa

SEQ ID NO: 6522 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgccaggcacggcccattggggttrcttttttagaaaaaaagaaaaaaaa

SEQ ID NO: 6523 - DNA, 50 bp, Artificial Sequence
  synthetic Elaeis guineensis (oil palm) single nucleotide polymorphism (SNP) in genomic region adjacent to shatterproof1 (SHELL) shell thickness gene
atatttttattttttcaaattatcyctaaaattagccgttttatgattgt

SEQ ID NO: 6524 - DNA, 50 bp, Artificial Sequence
  synthetic Elaeis guineensis (oil palm) single nucleotide polymorphism (SNP) in genomic region adjacent to shatterproof1 (SHELL) shell thickness gene
acgaggagggtatttacagaaatcytaatatttttattttttcaaattat

SEQ ID NO: 6525 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaaaatagacgaggagggtatttayagaaatcctaatatttttatttttt

SEQ ID NO: 6526 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttgctaattgctaaatattgaatayttgctaaatattgctagaagagtaa

SEQ ID NO: 6527 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaatagaggtaggtggagatttggrgcttcctcttgtgctcctcaggacc

SEQ ID NO: 6528 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttggtttcagaggaagcagaaacartagtttcttctccattagaaatcag

SEQ ID NO: 6529 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatactcttcaaaattaaaagactyatataagctaaaagataattcattc

SEQ ID NO: 6530 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttactaaaaaattagtcatagctaytcttctaaatgtacatttactggtt

SEQ ID NO: 6531 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatcaatataatgagcagtagcagyaataaaataataactatcaacatat

SEQ ID NO: 6532 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttattatctagaatgtgaaaaatmaaaaatacgaaaagcaagaatacgt

SEQ ID NO: 6533 - DNA, 50 bp, Artificial Sequence
  synthetic Elaeis guineensis (oil palm) single nucleotide polymorphism (SNP) in genomic region adjacent to shatterproof1 (SHELL) shell thickness gene
taacagcagaattattattagatayattgtcaaaagtaatagacataatt

SEQ ID NO: 6534 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttgaacaaagagatttaaaatatgrcattcacatctaatatgcagtaaat

SEQ ID NO: 6535 - DNA, 50 bp, Artificial Sequence
  synthetic Elaeis guineensis (oil palm) single nucleotide polymorphism (SNP) in genomic region adjacent to shatterproof1 (SHELL) shell thickness gene
aataacatcttgaaccatatgtcarattgaacaaagagatttaaaatatg

SEQ ID NO: 6536 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttgctcttgaagtatgaataaaaraaactgcatttctaatttttataat

SEQ ID NO: 6537 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctatacatatttgcttaaatttttraagttttgctcttgaagtatgaata

SEQ ID NO: 6538 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcaaaattttatctttgttccaatmattttcgatcaatgtaaaacttaat

SEQ ID NO: 6539 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaacatcatcatatctatgttgtayaaatttttggctaataagatatgct

SEQ ID NO: 6540 - DNA, 50 bp, Artificial Sequence
  synthetic Elaeis guineensis (oil palm) single nucleotide polymorphism (SNP) in genomic region adjacent to shatterproof1 (SHELL) shell thickness gene
catatcctatcccaatactcattcyatttagattccattttataaataat

SEQ ID NO: 6541 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagaagcatgtgtatgtctcctatstgcaatgaatgagaaaatagatgat

SEQ ID NO: 6542 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtcattgtcatcggatgttgtatcrtgtccacctttatcttgaagtctca

SEQ ID NO: 6543 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtcggcagtgtttgtgtcgtcattrtcatcggatgttgtatcgtgtccac

SEQ ID NO: 6544 - DNA, 50 bp, Artificial Sequence
  synthetic Elaeis guineensis (oil palm) single nucleotide polymorphism (SNP) in genomic region adjacent to shatterproof1 (SHELL) shell thickness gene
agcaaaattaaatatagatgttagrttttttttgtaaaaataaaaaacca

SEQ ID NO: 6545 - DNA, 50 bp, Artificial Sequence
  synthetic Elaeis guineensis (oil palm) single nucleotide polymorphism (SNP) in genomic region adjacent to shatterproof1 (SHELL) shell thickness gene
tagacatgggcaacaggccgggccrcccaatacacagcctggcctggcac

SEQ ID NO: 6546 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttagcaaagtatcatcaacttttgraggttcatctactttggtagaatga

SEQ ID NO: 6547 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatatgagcaatatatgtgcttaaraaattttataagcattatttcaatg

SEQ ID NO: 6548 - DNA, 50 bp, Artificial Sequence
  synthetic Elaeis guineensis (oil palm) single nucleotide polymorphism (SNP) in genomic region adjacent to shatterproof1 (SHELL) shell thickness gene
atccaaatttcatcaaacatagtgmttgctccatttacgtttccatattt

SEQ ID NO: 6549 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctaaaatgattcaccttctatcatmtttcgtaggcagtttatattctaaa

SEQ ID NO: 6550 - DNA, 50 bp, Artificial Sequence
  synthetic Elaeis guineensis (oil palm) single nucleotide polymorphism (SNP) in genomic region adjacent to shatterproof1 (SHELL) shell thickness gene
actaatgaggttaaataattacttrtagtcatcatttttaagtttaacat

SEQ ID NO: 6551 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctagtttcacaatgtaagccctaayagcatcatgccatcatacctaaata

SEQ ID NO: 6552 - DNA, 50 bp, Artificial Sequence
  synthetic Elaeis guineensis (oil palm) single nucleotide polymorphism (SNP) in genomic region adjacent to shatterproof1 (SHELL) shell thickness gene
taggtgcaatactctctagtttcayaatgtaagccctaacagcatcatgc

SEQ ID NO: 6553 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcaagaaaaatattagggatagggrtctcaaactattaaacttaggtgca

SEQ ID NO: 6554 - DNA, 50 bp, Artificial Sequence
  synthetic Elaeis guineensis (oil palm) single nucleotide polymorphism (SNP) in genomic region adjacent to shatterproof1 (SHELL) shell thickness gene
caaattacataaggagagagttaaragcttaatgagcaagaaaaatatta

SEQ ID NO: 6555 - DNA, 50 bp, Artificial Sequence
  synthetic Elaeis guineensis (oil palm) single nucleotide polymorphism (SNP) in genomic region adjacent to shatterproof1 (SHELL) shell thickness gene
attagtattggatttcctactaacrgacaactcaaaagaatcttgtaaac

SEQ ID NO: 6556 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctgcatagtcaattaaataacaayaattagttctagtccaaactttcat

SEQ ID NO: 6557 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatactttagtattatctgcatagycaattaaataacaacaattagttct

SEQ ID NO: 6558 - DNA, 50 bp, Artificial Sequence
  synthetic Elaeis guineensis (oil palm) single nucleotide polymorphism (SNP) in genomic region adjacent to shatterproof1 (SHELL) shell thickness gene
attcttatacctcttgtcaggacartagaatctatatactttagtattat

SEQ ID NO: 6559 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctggtatttcattaactggttatgraggtgctataatcgatttatatatt

SEQ ID NO: 6560 - DNA, 50 bp, Artificial Sequence
  synthetic Elaeis guineensis (oil palm) single nucleotide polymorphism (SNP) in genomic region adjacent to shatterproof1 (SHELL) shell thickness gene
tggtcattaagaatgatgagttttycttttttttaatgatatctttactg

SEQ ID NO: 6561 - DNA, 50 bp, Artificial Sequence
  synthetic Elaeis guineensis (oil palm) single nucleotide polymorphism (SNP) in genomic region adjacent to shatterproof1 (SHELL) shell thickness gene
tacaagagactgaattatccatatrgtcaatgccatagtcattctcatct

SEQ ID NO: 6562 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatttttctaatgaagctgtaggtyaaaacgggttatcagtgttatgatt

SEQ ID NO: 6563 - DNA, 50 bp, Artificial Sequence
  synthetic Elaeis guineensis (oil palm) single nucleotide polymorphism (SNP) in genomic region adjacent to shatterproof1 (SHELL) shell thickness gene
tagatttaccttttaggtctgtatrccatatgttttttcccactctcaat

SEQ ID NO: 6564 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctcccttgaccacatgtacatctytaggtttgcaattagacataccaaa

SEQ ID NO: 6565 - DNA, 50 bp, Artificial Sequence
  synthetic Elaeis guineensis (oil palm) single nucleotide polymorphism (SNP) in genomic region adjacent to shatterproof1 (SHELL) shell thickness gene
cttttctacattattctaaggacaytggtttctactgaatttgtctccct

SEQ ID NO: 6566 - DNA, 50 bp, Artificial Sequence
  synthetic Elaeis guineensis (oil palm) single nucleotide polymorphism (SNP) in genomic region adjacent to shatterproof1 (SHELL) shell thickness gene
atcatatatgctatatctgatctgrcacaaatctttgtatatataaaact

SEQ ID NO: 6567 - DNA, 50 bp, Artificial Sequence
  synthetic Elaeis guineensis (oil palm) single nucleotide polymorphism (SNP) in genomic region adjacent to shatterproof1 (SHELL) shell thickness gene
agcttattgccttaagatgatcagwctttcaaaaaaaaaaaagagttgac

SEQ ID NO: 6568 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaattcaaaatcacgatagcttatygccttaagatgatcagtctttcaaa

SEQ ID NO: 6569 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaaaagaacataactgcaccataaycatagtaaatctgaagtggtttcga

SEQ ID NO: 6570 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatgtattcaattacaatgagtccsttttaatcgaatctctgactgtcaa

SEQ ID NO: 6571 - DNA, 50 bp, Artificial Sequence
  synthetic Elaeis guineensis (oil palm) single nucleotide polymorphism (SNP) in genomic region adjacent to shatterproof1 (SHELL) shell thickness gene
atatgatgttcaacaaaaaataatratcccactaaccaaacatatcaaaa

SEQ ID NO: 6572 - DNA, 50 bp, Artificial Sequence
  synthetic Elaeis guineensis (oil palm) single nucleotide polymorphism (SNP) in genomic region adjacent to shatterproof1 (SHELL) shell thickness gene
atgcttaaggctttcatttaaacakcatttacaaacaaccatatgtgcat

SEQ ID NO: 6573 - DNA, 50 bp, Artificial Sequence
  synthetic Elaeis guineensis (oil palm) single nucleotide polymorphism (SNP) in genomic region adjacent to shatterproof1 (SHELL) shell thickness gene
taagtaatattttcatgcttaaacrgcacatttatgcttaagacttctat

SEQ ID NO: 6574 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctcaaggcgaatcatgatatcaaygatatcattataacataagtaatat

SEQ ID NO: 6575 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatacaaagctcatcatcagtccaytttacgatttcaaatgaaacccttt

SEQ ID NO: 6576 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttctagtgatgtagtgcatgtagtrtgaactttatatccatgtgatcaaa

SEQ ID NO: 6577 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccactaacattgaatcacagcaatyttcatatcatttattgatattagac

SEQ ID NO: 6578 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttcatttagatggcaacttagtccktattttttataacaaatcagaataa

SEQ ID NO: 6579 - DNA, 50 bp, Artificial Sequence
  synthetic Elaeis guineensis (oil palm) single nucleotide polymorphism (SNP) in genomic region adjacent to shatterproof1 (SHELL) shell thickness gene
atgtcaataatatgcaatttaatgycattttgaggttgtatttatcaatt

SEQ ID NO: 6580 - DNA, 50 bp, Artificial Sequence
  synthetic Elaeis guineensis (oil palm) single nucleotide polymorphism (SNP) in genomic region adjacent to shatterproof1 (SHELL) shell thickness gene
cgctatctaactcaaaattgaaccmaaatatgtcaataatatgcaattta

SEQ ID NO: 6581 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctttagttttaagatgacatagtwgaaatataatgtaaataaatatatg

SEQ ID NO: 6582 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaccgcctggtacggtgcgtaccragccggaccgatgccttaccggtcc

SEQ ID NO: 6583 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtttggcgaactaagatgtggggawtgtattgaagaatattttcccatga

SEQ ID NO: 6584 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaaatacggtgtagatgccaccaygatgttcaaaaccctagatatctcg

SEQ ID NO: 6585 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtcacatttcaatgatggtcaaccyctacttcatattgctcatatcaagg

SEQ ID NO: 6586 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcatttacttctgtcttaatagatkattaaagaaccaaaggagtacctat

SEQ ID NO: 6587 - DNA, 50 bp, Artificial Sequence
  synthetic Elaeis guineensis (oil palm) single nucleotide polymorphism (SNP) in genomic region adjacent to shatterproof1 (SHELL) shell thickness gene
atagatacttgtatttgttcatgcygcatacatgcatgacttccaaattg

SEQ ID NO: 6588 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttatatttgtttatttactaatcrttatatctgaactacctttatggta

SEQ ID NO: 6589 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttacttttttactgtttcattaatkgtttgtacattttttttcctgcata

SEQ ID NO: 6590 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatccttatctctacaaacttgtcrtaagaaaataactactgccatcccc

SEQ ID NO: 6591 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatttctccttgattttatgtataratccaaatatgtgtttatgcaccaa

SEQ ID NO: 6592 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttttgcctgtcttttcagttctttrtgactataagagttctgcttatttt

SEQ ID NO: 6593 - DNA, 50 bp, Artificial Sequence
  synthetic Elaeis guineensis (oil palm) single nucleotide polymorphism (SNP) in genomic region adjacent to shatterproof1 (SHELL) shell thickness gene
cagctatcgagaaagaatatccacrggaatcagtcctaatgagctttaat

SEQ ID NO: 6594 - DNA, 50 bp, Artificial Sequence
  synthetic Elaeis guineensis (oil palm) single nucleotide polymorphism (SNP) in genomic region adjacent to shatterproof1 (SHELL) shell thickness gene
gagttttaaaactttcatctccttmaaattgcagggaattgtgcatgcac

SEQ ID NO: 6595 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaggcacaccggttagcttgacatmctgatgctttttcagccataaggag

SEQ ID NO: 6596 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgcaggacctgctatgaatttatgyggaaagtggggaatcaatcatgtcc

SEQ ID NO: 6597 - DNA, 50 bp, Artificial Sequence
  synthetic Elaeis guineensis (oil palm) single nucleotide polymorphism (SNP) in genomic region adjacent to shatterproof1 (SHELL) shell thickness gene
gggtctcatcaagatgggaggccayctcttgcttgcaacgagtgtggata

SEQ ID NO: 6598 - DNA, 50 bp, Artificial Sequence
  synthetic Elaeis guineensis (oil palm) single nucleotide polymorphism (SNP) in genomic region adjacent to shatterproof1 (SHELL) shell thickness gene
tccaaggccttagtatatcgctatrtttttccagatcagaaagaaaatac

SEQ ID NO: 6599 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttgaatacatttgggtggtgcaatrttgtactagcactttaattcttata

SEQ ID NO: 6600 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgaaagtaacttgccttttaaaatkggctaccttctttcaactttatcta

SEQ ID NO: 6601 - DNA, 50 bp, Artificial Sequence
  synthetic Elaeis guineensis (oil palm) single nucleotide polymorphism (SNP) in genomic region adjacent to shatterproof1 (SHELL) shell thickness gene
acggctgaaagtaacttgccttttraaatgggctaccttctttcaacttt

SEQ ID NO: 6602 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctccttggtttttatctttgcaaaygcttccagctcgctaagtaatagcc

SEQ ID NO: 6603 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctttgtattgctagtcctccttggyttttatctttgcaaatgcttccagc

SEQ ID NO: 6604 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggaattaaggatcatggattccatwtatctttgccatttgaaagcagttt

SEQ ID NO: 6605 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtcaactgccatactgaaaaggttwggaaacatttatatcagtactactc

SEQ ID NO: 6606 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctgactttgttcatctgctgtggkggtaaagtagaaatctgtatctaat

SEQ ID NO: 6607 - DNA, 50 bp, Artificial Sequence
  synthetic Elaeis guineensis (oil palm) single nucleotide polymorphism (SNP) in genomic region adjacent to shatterproof1 (SHELL) shell thickness gene
gattttaccttcccaggagctggarccttccatacatgttttcatccttt

SEQ ID NO: 6608 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttgtcgttttatgtctacaagacawatgaaattcaatatctgtagcatca

SEQ ID NO: 6609 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccaacctttaaattgtaacttttcygtacaactcttccaaattcttcttg

SEQ ID NO: 6610 - DNA, 50 bp, Artificial Sequence
  synthetic Elaeis guineensis (oil palm) single nucleotide polymorphism (SNP) in genomic region adjacent to shatterproof1 (SHELL) shell thickness gene
atatatatatttatatttctttttkttattttattttatgttattttttg

SEQ ID NO: 6611 - DNA, 50 bp, Artificial Sequence
  synthetic Elaeis guineensis (oil palm) single nucleotide polymorphism (SNP) in genomic region adjacent to shatterproof1 (SHELL) shell thickness gene
cactgattctcttttgaatttggaygttccgacctgtcccaatcatctga

SEQ ID NO: 6612 - DNA, 50 bp, Artificial Sequence
  synthetic Elaeis guineensis (oil palm) single nucleotide polymorphism (SNP) in genomic region adjacent to shatterproof1 (SHELL) shell thickness gene
attaaaatatatttcctgccaactrgtcttttggttttggtcttcagact

SEQ ID NO: 6613 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaggagagctgttgtattaactgtkcttattcttgtagaacaaaggagca

SEQ ID NO: 6614 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtggaatcttttcttttctttcccyttttcttttgtctccactaaatctt

SEQ ID NO: 6615 - DNA, 50 bp, Artificial Sequence
  synthetic Elaeis guineensis (oil palm) single nucleotide polymorphism (SNP) in genomic region adjacent to shatterproof1 (SHELL) shell thickness gene
cttgtttctcttcccattcctcttyccattcttctgccagcacccccacc

SEQ ID NO: 6616 - DNA, 50 bp, Artificial Sequence
  synthetic Elaeis guineensis (oil palm) single nucleotide polymorphism (SNP) in genomic region adjacent to shatterproof1 (SHELL) shell thickness gene
caggaccgggtcttgtttctcttcmcattcctctttccattcttctgcca

SEQ ID NO: 6617 - DNA, 50 bp, Artificial Sequence
  synthetic Elaeis guineensis (oil palm) single nucleotide polymorphism (SNP) in genomic region adjacent to shatterproof1 (SHELL) shell thickness gene
attcggatcgatttctgtgatcttyctcggatcgaaatattcatgatctt

SEQ ID NO: 6618 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctttggactaccaggatcatgcgaygatcttttattcggatcgatttctg

SEQ ID NO: 6619 - DNA, 50 bp, Artificial Sequence
  synthetic Elaeis guineensis (oil palm) single nucleotide polymorphism (SNP) in genomic region adjacent to shatterproof1 (SHELL) shell thickness gene
taaatccttttctttttggctttgrctttggactaccaggatcatgcgac

SEQ ID NO: 6620 - DNA, 50 bp, Artificial Sequence
  synthetic Elaeis guineensis (oil palm) single nucleotide polymorphism (SNP) in genomic region adjacent to shatterproof1 (SHELL) shell thickness gene
gttcactgtccagaatactgcaaayatttatagattatctgttttatcaa

SEQ ID NO: 6621 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaagataagcaataacacataaaartcgatgttcactgtccagaatactg

SEQ ID NO: 6622 - DNA, 50 bp, Artificial Sequence
  synthetic Elaeis guineensis (oil palm) single nucleotide polymorphism (SNP) in genomic region adjacent to shatterproof1 (SHELL) shell thickness gene
atcacatgaatataataatataatmtgaaaataaagataagcaataacac

SEQ ID NO: 6623 - DNA, 50 bp, Artificial Sequence
  synthetic Elaeis guineensis (oil palm) single nucleotide polymorphism (SNP) in genomic region adjacent to shatterproof1 (SHELL) shell thickness gene
atccaggccacagccaatcataagyatcctgtaactctgagaagaaaaga

SEQ ID NO: 6624 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttcaattctctgatcagatactatracactcttatttattcttctgctca

SEQ ID NO: 6625 - DNA, 50 bp, Artificial Sequence
  synthetic Elaeis guineensis (oil palm) single nucleotide polymorphism (SNP) in genomic region adjacent to shatterproof1 (SHELL) shell thickness gene
caacaataattcataaaatcttgcrtaattacaatttaaatttcttcaat

SEQ ID NO: 6626 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttatttcaacaataattcataaaaycttgcgtaattacaatttaaatttc

SEQ ID NO: 6627 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttattttaaaatataatattttttytgtcatgcctcgaacccaacatccg

SEQ ID NO: 6628 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtagtggagaagatattgatcagtyttacatagatctgaatattatggaa

SEQ ID NO: 6629 - DNA, 50 bp, Artificial Sequence
  synthetic Elaeis guineensis (oil palm) single nucleotide polymorphism (SNP) in genomic region adjacent to shatterproof1 (SHELL) shell thickness gene
cggggatcggggagggttctcgcaycgggaggaggagggagaggtggggc

SEQ ID NO: 6630 - DNA, 50 bp, Artificial Sequence
  synthetic Elaeis guineensis (oil palm) single nucleotide polymorphism (SNP) in genomic region adjacent to shatterproof1 (SHELL) shell thickness gene
gggcgattcatagagtcatcttatmttaagatgactctataagtttccta

SEQ ID NO: 6631 - DNA, 50 bp, Artificial Sequence
  synthetic Elaeis guineensis (oil palm) single nucleotide polymorphism (SNP) in genomic region adjacent to shatterproof1 (SHELL) shell thickness gene
attttaaacctaaatatattctcargtctaacaaataatccaagctcatg

SEQ ID NO: 6632 - DNA, 50 bp, Artificial Sequence
  synthetic Elaeis guineensis (oil palm) single nucleotide polymorphism (SNP) in genomic region adjacent to shatterproof1 (SHELL) shell thickness gene
tggacatcatctttgatccaaataytccaacaaaagacaacctcctaatc

SEQ ID NO: 6633 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatcttagatacttatgcaggttamagaatccaaataacatattttggac

SEQ ID NO: 6634 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttgatttaaggtcgcttgccttcgwtgcatgcatggtaactatcagacct

SEQ ID NO: 6635 - DNA, 50 bp, Artificial Sequence
  synthetic Elaeis guineensis (oil palm) single nucleotide polymorphism (SNP) in genomic region adjacent to shatterproof1 (SHELL) shell thickness gene
acgaggaagaagggcttgcaccagmggggacatctaaaactccaagttca

SEQ ID NO: 6636 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtttatgctctactataaatatatrtggacccgccgtgagaatgcccgtc

SEQ ID NO: 6637 - DNA, 50 bp, Artificial Sequence
  synthetic Elaeis guineensis (oil palm) single nucleotide polymorphism (SNP) in genomic region adjacent to shatterproof1 (SHELL) shell thickness gene
cttcaatctgatgagaaagtatttmgaaattcccagcttaactacaacat

SEQ ID NO: 6638 - DNA, 50 bp, Artificial Sequence
  synthetic Elaeis guineensis (oil palm) single nucleotide polymorphism (SNP) in genomic region adjacent to shatterproof1 (SHELL) shell thickness gene
acaagagttaactaaaacagaatcktcaatctgatgagaaagtatttcga

SEQ ID NO: 6639 - DNA, 50 bp, Artificial Sequence
  synthetic Elaeis guineensis (oil palm) single nucleotide polymorphism (SNP) in genomic region adjacent to shatterproof1 (SHELL) shell thickness gene
aggactgcttatctaataggcctaytgaaaaataatttacaagagttaac

SEQ ID NO: 6640 - DNA, 50 bp, Artificial Sequence
  synthetic Elaeis guineensis (oil palm) single nucleotide polymorphism (SNP) in genomic region adjacent to shatterproof1 (SHELL) shell thickness gene
atttagattcatctcctgcaacatrgagtagcagaaaacctttggtgttc

SEQ ID NO: 6641 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttttttttttagaattaatttagrttcatctcctgcaacatggagtagc

SEQ ID NO: 6642 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtgtatagattctaattaaaagtgycatccattatttacacatttaatta

SEQ ID NO: 6643 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtggaaatggggtgccgtaaacttrcataatgctgatgtgtatagattct

SEQ ID NO: 6644 - DNA, 50 bp, Artificial Sequence
  synthetic Elaeis guineensis (oil palm) single nucleotide polymorphism (SNP) in genomic region adjacent to shatterproof1 (SHELL) shell thickness gene
gggcggcgtgaagggtggaaatggrgtgccgtaaacttacataatgctga

SEQ ID NO: 6645 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttagaagatctaggtgaaccaattwgttcttttagtagatacagtgaatg

SEQ ID NO: 6646 - DNA, 50 bp, Artificial Sequence
  synthetic Elaeis guineensis (oil palm) single nucleotide polymorphism (SNP) in genomic region adjacent to shatterproof1 (SHELL) shell thickness gene
cctaccctaatttctgtgcccgtakgtctttatatgtttaaattgccttg

SEQ ID NO: 6647 - DNA, 50 bp, Artificial Sequence
  synthetic Elaeis guineensis (oil palm) single nucleotide polymorphism (SNP) in genomic region adjacent to shatterproof1 (SHELL) shell thickness gene
actagttatgggctatctgaatgasagcaagttaacctgtctgccctcct

SEQ ID NO: 6648 - DNA, 50 bp, Artificial Sequence
  synthetic Elaeis guineensis (oil palm) single nucleotide polymorphism (SNP) in genomic region adjacent to shatterproof1 (SHELL) shell thickness gene
atggaacggcatcaaaccacatacsttggtatgagatagaaggattgggc

SEQ ID NO: 6649 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctgtggaccacacggctaaaagagmgtagtcttctgcttcaccctatgtc

SEQ ID NO: 6650 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccgatacatgctggatagtaatttraagtgggtctgtcagcccatcaaat

SEQ ID NO: 6651 - DNA, 50 bp, Artificial Sequence
  synthetic Elaeis guineensis (oil palm) single nucleotide polymorphism (SNP) in genomic region adjacent to shatterproof1 (SHELL) shell thickness gene
gatttgaaagattgactcatatggyggcatttaaatgctaagactagagc

SEQ ID NO: 6652 - DNA, 50 bp, Artificial Sequence
  synthetic Elaeis guineensis (oil palm) single nucleotide polymorphism (SNP) in genomic region adjacent to shatterproof1 (SHELL) shell thickness gene
gattattgatatgatgagctcttayttgatagttaatatgtggatatata

SEQ ID NO: 6653 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtcgtttcttgtgattattgatatsatgagctcttacttgatagttaata

SEQ ID NO: 6654 - DNA, 50 bp, Artificial Sequence
  synthetic Elaeis guineensis (oil palm) single nucleotide polymorphism (SNP) in genomic region adjacent to shatterproof1 (SHELL) shell thickness gene
taagtatacaattagctgctattamatggcacgggattgtttataaaatt

SEQ ID NO: 6655 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcttgccacatcaagtcatgggttmgatcatccaagcaagaggaaaaaac

SEQ ID NO: 6656 - DNA, 50 bp, Artificial Sequence
  synthetic Elaeis guineensis (oil palm) single nucleotide polymorphism (SNP) in genomic region adjacent to shatterproof1 (SHELL) shell thickness gene
atgtggccttcatcaatccgtacaygtgattatttaaggaacaatggata

SEQ ID NO: 6657 - DNA, 50 bp, Artificial Sequence
  synthetic Elaeis guineensis (oil palm) single nucleotide polymorphism (SNP) in genomic region adjacent to shatterproof1 (SHELL) shell thickness gene
acatgtggccttcatcaatccgtamacgtgattatttaaggaacaatgga

SEQ ID NO: 6658 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaccatccaaattttttagattacraggaggcccaccacctaacatgtgg

SEQ ID NO: 6659 - DNA, 50 bp, Artificial Sequence
  synthetic Elaeis guineensis (oil palm) single nucleotide polymorphism (SNP) in genomic region adjacent to shatterproof1 (SHELL) shell thickness gene
atatggaacattgaaaatcctttcyaaccatccaaattttttagattacg

SEQ ID NO: 6660 - DNA, 50 bp, Artificial Sequence
  synthetic Elaeis guineensis (oil palm) single nucleotide polymorphism (SNP) in genomic region adjacent to shatterproof1 (SHELL) shell thickness gene
atatatcttcatatagtgtcggtcyttattttttctttcttttcttattg

SEQ ID NO: 6661 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttgataaaaataggaaataaaagytactgaaaatccggaagcatcttca

SEQ ID NO: 6662 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttttattttttttgataaaaatargaaataaaagttactgaaaatccgg

SEQ ID NO: 6663 - DNA, 50 bp, Artificial Sequence
  synthetic Elaeis guineensis (oil palm) single nucleotide polymorphism (SNP) in genomic region adjacent to shatterproof1 (SHELL) shell thickness gene
gattttttattttttttgataaaawtaggaaataaaagttactgaaaatc

SEQ ID NO: 6664 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggtaaaaagataccttaaaaagggmgtgatccattaatttaaaaacctag

SEQ ID NO: 6665 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgatctccacgcggtttgatgatcwccaggcgaggggctcgacaaaagtg

SEQ ID NO: 6666 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttgaacaagcacgcccttttcccakattaaatccactcgccctggacttt

SEQ ID NO: 6667 - DNA, 50 bp, Artificial Sequence
  synthetic Elaeis guineensis (oil palm) single nucleotide polymorphism (SNP) in genomic region adjacent to shatterproof1 (SHELL) shell thickness gene
atacggaggattactttgaaaattyttaaaggaaaagggggtatgtgtga

SEQ ID NO: 6668 - DNA, 50 bp, Artificial Sequence
  synthetic Elaeis guineensis (oil palm) single nucleotide polymorphism (SNP) in genomic region adjacent to shatterproof1 (SHELL) shell thickness gene
agacgttcatgaactggtggccgtwggaaatgttgtccaaacaactgata

SEQ ID NO: 6669 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttggtatgcgtcaaattgaaaggcrctgcttctcaaagattgaaacaatg

SEQ ID NO: 6670 - DNA, 50 bp, Artificial Sequence
  synthetic Elaeis guineensis (oil palm) single nucleotide polymorphism (SNP) in genomic region adjacent to shatterproof1 (SHELL) shell thickness gene
cgagccacaagaaaactttccatgrtggtcttgcatacaaaattttattt

SEQ ID NO: 6671 - DNA, 50 bp, Artificial Sequence
  synthetic Elaeis guineensis (oil palm) single nucleotide polymorphism (SNP) in genomic region adjacent to shatterproof1 (SHELL) shell thickness gene
atacagttgtcaacctaacatgcaycggcacttaaggaatgatagcgtgg

SEQ ID NO: 6672 - DNA, 50 bp, Artificial Sequence
  synthetic Elaeis guineensis (oil palm) single nucleotide polymorphism (SNP) in genomic region adjacent to shatterproof1 (SHELL) shell thickness gene
attcttgtgtacttcacctcttttkgtatatttcttttctttttttaaat

SEQ ID NO: 6673 - DNA, 50 bp, Artificial Sequence
  synthetic Elaeis guineensis (oil palm) single nucleotide polymorphism (SNP) in genomic region adjacent to shatterproof1 (SHELL) shell thickness gene
taatcttaataaccatatgtacaaytgtacactatgctacaatagttccc

SEQ ID NO: 6674 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttaagttagtagtatcattttgtcmaacattaaagaacaaaacttttact

SEQ ID NO: 6675 - DNA, 50 bp, Artificial Sequence
  synthetic Elaeis guineensis (oil palm) single nucleotide polymorphism (SNP) in genomic region adjacent to shatterproof1 (SHELL) shell thickness gene
cgtcgtcgccgccgtccggcatgaracgaaggacgccgccgtaatcatca

SEQ ID NO: 6676 - DNA, 50 bp, Artificial Sequence
  synthetic Elaeis guineensis (oil palm) single nucleotide polymorphism (SNP) in genomic region adjacent to shatterproof1 (SHELL) shell thickness gene
cacgactggtggtaatagtagcagwcctagtggtggcaaacagaaaacaa

SEQ ID NO: 6677 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaatcccgtgttgcttgaatggccsaacgtagcaactacttgggttggag

SEQ ID NO: 6678 - DNA, 50 bp, Artificial Sequence
  synthetic Elaeis guineensis (oil palm) single nucleotide polymorphism (SNP) in genomic region adjacent to shatterproof1 (SHELL) shell thickness gene
attgaccaatcaaaaagttaaacarccactgtatctttttcacgagattt

SEQ ID NO: 6679 - DNA, 50 bp, Artificial Sequence
  synthetic Elaeis guineensis (oil palm) single nucleotide polymorphism (SNP) in genomic region adjacent to shatterproof1 (SHELL) shell thickness gene
gttgattgaccaatcaaaaggctasacaagtacagagcagtgaattgacc

SEQ ID NO: 6680 - DNA, 50 bp, Artificial Sequence
  synthetic Elaeis guineensis (oil palm) single nucleotide polymorphism (SNP) in genomic region adjacent to shatterproof1 (SHELL) shell thickness gene
gctgcttgttggtactcgacaacawacaatacatcagttttcatcaaaaa

SEQ ID NO: 6681 - DNA, 50 bp, Artificial Sequence
  synthetic Elaeis guineensis (oil palm) single nucleotide polymorphism (SNP) in genomic region adjacent to shatterproof1 (SHELL) shell thickness gene
tggtaaatgtttcttgatgcaattygtcagctaattgacccatcaaaagg

SEQ ID NO: 6682 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagtaacagctaacaatggtgtttrttatacatgaagaaccttcacagct

SEQ ID NO: 6683 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccacatgctcaagaaacttagagamacatataaagtaacagctaacaatg

SEQ ID NO: 6684 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctcgtctccgactccgattgggagycggcgagaggaggaagaagactccc

SEQ ID NO: 6685 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttgaagcatgatggcacctgaagwctaagtcatttgcggcatttgaaga

SEQ ID NO: 6686 - DNA, 50 bp, Artificial Sequence
  synthetic Elaeis guineensis (oil palm) single nucleotide polymorphism (SNP) in genomic region adjacent to shatterproof1 (SHELL) shell thickness gene
gagggctatcaaggcaacatggtawggtaacatcatggcagtagctagtt

SEQ ID NO: 6687 - DNA, 50 bp, Artificial Sequence
  synthetic Elaeis guineensis (oil palm) single nucleotide polymorphism (SNP) in genomic region adjacent to shatterproof1 (SHELL) shell thickness gene
accaaagaggtagttgatgattcawaagcttgtatttattaatgacaaca

SEQ ID NO: 6688 - DNA, 50 bp, Artificial Sequence
  synthetic Elaeis guineensis (oil palm) single nucleotide polymorphism (SNP) in genomic region adjacent to shatterproof1 (SHELL) shell thickness gene
atctgttgcacttaaaaacaaatargaggaaggtccaaccaaagtaacaa

SEQ ID NO: 6689 - DNA, 50 bp, Artificial Sequence
  synthetic Elaeis guineensis (oil palm) single nucleotide polymorphism (SNP) in genomic region adjacent to shatterproof1 (SHELL) shell thickness gene
cgcgccctactataaaacggagaargcaacagtgctggtaaaggttcttt

SEQ ID NO: 6690 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccatgccgcgccctactataaaacrgagaaagcaacagtgctggtaaagg

SEQ ID NO: 6691 - DNA, 50 bp, Artificial Sequence
  synthetic Elaeis guineensis (oil palm) single nucleotide polymorphism (SNP) in genomic region adjacent to shatterproof1 (SHELL) shell thickness gene
caccgataggacgcatgacaccgaygggacgcctgacaccgacgggacgc

SEQ ID NO: 6692 - DNA, 50 bp, Artificial Sequence
  synthetic Elaeis guineensis (oil palm) single nucleotide polymorphism (SNP) in genomic region adjacent to shatterproof1 (SHELL) shell thickness gene
gttcggcccaacggccccccgccaygtggcggaagagtcgtggcggttcg

SEQ ID NO: 6693 - DNA, 50 bp, Artificial Sequence
  synthetic Elaeis guineensis (oil palm) single nucleotide polymorphism (SNP) in genomic region adjacent to shatterproof1 (SHELL) shell thickness gene
cgaccagcgaggatctcccagatcrtgacgcgtggcaatatctgggcctt

SEQ ID NO: 6694 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggtcgagatgaaggcacgaccagckaggatctcccagatcgtgacgcgtg

SEQ ID NO: 6695 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaaagaggaggactacgaggaagcraggaagagaacaaaggacaatgggg

SEQ ID NO: 6696 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaagaggaagaaagaggaggactaygaggaagcgaggaagagaacaaagg

SEQ ID NO: 6697 - DNA, 50 bp, Artificial Sequence
  synthetic Elaeis guineensis (oil palm) single nucleotide polymorphism (SNP) in genomic region adjacent to shatterproof1 (SHELL) shell thickness gene
aggagatattctagccattacgccrgaacagaggtcaaagaataaaagag

SEQ ID NO: 6698 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaccgacttcctcgaggagatattytagccattacgccggaacagaggtc

SEQ ID NO: 6699 - DNA, 50 bp, Artificial Sequence
  synthetic Elaeis guineensis (oil palm) single nucleotide polymorphism (SNP) in genomic region adjacent to shatterproof1 (SHELL) shell thickness gene
cgttcggccccgaaagtgaagagayctccacctccagggtcgatcgagaa

SEQ ID NO: 6700 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggatgcagtactgctcccggagccratcaacgttcggccccgaaagtgaa

SEQ ID NO: 6701 - DNA, 50 bp, Artificial Sequence
  synthetic Elaeis guineensis (oil palm) single nucleotide polymorphism (SNP) in genomic region adjacent to shatterproof1 (SHELL) shell thickness gene
gctctgggatgcagtactgctcccrgagccgatcaacgttcggccccgaa

SEQ ID NO: 6702 - DNA, 50 bp, Artificial Sequence
  synthetic Elaeis guineensis (oil palm) single nucleotide polymorphism (SNP) in genomic region adjacent to shatterproof1 (SHELL) shell thickness gene
aggggcgaacagctgaaattgctcygggatgcagtactgctcccggagcc

SEQ ID NO: 6703 - DNA, 50 bp, Artificial Sequence
  synthetic Elaeis guineensis (oil palm) single nucleotide polymorphism (SNP) in genomic region adjacent to shatterproof1 (SHELL) shell thickness gene
cctcagacgggctgttaacccgacmattggctccaggggcgaacagctga

SEQ ID NO: 6704 - DNA, 50 bp, Artificial Sequence
  synthetic Elaeis guineensis (oil palm) single nucleotide polymorphism (SNP) in genomic region adjacent to shatterproof1 (SHELL) shell thickness gene
tagagatgtattaaaaagtgagtaktaccacatcatcacaaaatagatca

SEQ ID NO: 6705 - DNA, 50 bp, Artificial Sequence
  synthetic Elaeis guineensis (oil palm) single nucleotide polymorphism (SNP) in genomic region adjacent to shatterproof1 (SHELL) shell thickness gene
aggcctttgagagattgtggctackcatatcaaatcaaagagattttcta

SEQ ID NO: 6706 - DNA, 50 bp, Artificial Sequence
  synthetic Elaeis guineensis (oil palm) single nucleotide polymorphism (SNP) in genomic region adjacent to shatterproof1 (SHELL) shell thickness gene
acagtctaaactgatggggccatgygctgataagtcaatcttctcattct

SEQ ID NO: 6707 - DNA, 50 bp, Artificial Sequence
  synthetic Elaeis guineensis (oil palm) single nucleotide polymorphism (SNP) in genomic region adjacent to shatterproof1 (SHELL) shell thickness gene
ataaatatatatgctttttttaagytttattccagtatctatgtcatatt

SEQ ID NO: 6708 - DNA, 50 bp, Artificial Sequence
  synthetic Elaeis guineensis (oil palm) single nucleotide polymorphism (SNP) in genomic region adjacent to shatterproof1 (SHELL) shell thickness gene
aataaatatatatgctttttttaarctttattccagtatctatgtcatat

SEQ ID NO: 6709 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtctcactaagcaatatcatctggrgttttaatgttcagctgaagctgat

SEQ ID NO: 6710 - DNA, 50 bp, Artificial Sequence
  synthetic Elaeis guineensis (oil palm) single nucleotide polymorphism (SNP) in genomic region adjacent to shatterproof1 (SHELL) shell thickness gene
atccttctatttctcttcaaagcaratctgatacaggatagaaactgttt

SEQ ID NO: 6711 - DNA, 50 bp, Artificial Sequence
  synthetic Elaeis guineensis (oil palm) single nucleotide polymorphism (SNP) in genomic region adjacent to shatterproof1 (SHELL) shell thickness gene
atagcaaacagcaaatggggatccragggctgtcgaaacatataacatgg

SEQ ID NO: 6712 - DNA, 50 bp, Artificial Sequence
  synthetic Elaeis guineensis (oil palm) single nucleotide polymorphism (SNP) in genomic region adjacent to shatterproof1 (SHELL) shell thickness gene
caatcagaattgctttattgttggrgaaaaacatatattgccaattgcaa

SEQ ID NO: 6713 - DNA, 50 bp, Artificial Sequence
  synthetic Elaeis guineensis (oil palm) single nucleotide polymorphism (SNP) in genomic region adjacent to shatterproof1 (SHELL) shell thickness gene
catataaaaaaacttactttttaawatgaaagaaggggaaaaaggtctgt

SEQ ID NO: 6714 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgaatggactattttaccttttatmtttttttatttgatggatttaaaat

SEQ ID NO: 6715 - DNA, 50 bp, Artificial Sequence
  synthetic Elaeis guineensis (oil palm) single nucleotide polymorphism (SNP) in genomic region adjacent to shatterproof1 (SHELL) shell thickness gene
taaaaattccagaatatcaatatcrcacaactaatagaaagatcaagtga

SEQ ID NO: 6716 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcggcatttaaaaaacaagaaccayaactgcaaactgtttaaaagccgct

SEQ ID NO: 6717 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctgataccagtgactgaatctgaaycggatttgataagatcaaattcgaa

SEQ ID NO: 6718 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagaactgataccagtgactgaatytgaaccggatttgataagatcaaat

SEQ ID NO: 6719 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgggagtctaattgttgaaaaaatrcatcagtttagtaatataacctagc

SEQ ID NO: 6720 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaacaccggtgctattgtggctacwtgtcgaacgaagagtacaggcatta

SEQ ID NO: 6721 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgaaggaatcttatcacgagaccgyaattcaatggatgcagatatccagc

SEQ ID NO: 6722 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaatggttgtgtgttttataccartgtaaatctctacaccgttgttact

SEQ ID NO: 6723 - DNA, 50 bp, Artificial Sequence
  synthetic Elaeis guineensis (oil palm) single nucleotide polymorphism (SNP) in genomic region adjacent to shatterproof1 (SHELL) shell thickness gene
cttcaaactttggatggccatcaascctgagatttactgcttgtctgatg

SEQ ID NO: 6724 - DNA, 50 bp, Artificial Sequence
  synthetic Elaeis guineensis (oil palm) single nucleotide polymorphism (SNP) in genomic region adjacent to shatterproof1 (SHELL) shell thickness gene
tattcaggaggagagaggaggctcrgaggctgctcaaggaatcgcttcaa

SEQ ID NO: 6725 - DNA, 50 bp, Artificial Sequence
  synthetic Elaeis guineensis (oil palm) single nucleotide polymorphism (SNP) in genomic region adjacent to shatterproof1 (SHELL) shell thickness gene
taaaatctccttaatgcaagtaatyggagaacaaccaaacaaaggcgaac

SEQ ID NO: 6726 - DNA, 50 bp, Artificial Sequence
  synthetic Elaeis guineensis (oil palm) single nucleotide polymorphism (SNP) in genomic region adjacent to shatterproof1 (SHELL) shell thickness gene
atttgatctttgagaccgctgtacrtatcccctgattcttctgatttcta

SEQ ID NO: 6727 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttccctctgctgtctgtaattattygatctttgagaccgctgtacatatc

SEQ ID NO: 6728 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatttttacccaatttttccctctrctgtctgtaattatttgatctttga

SEQ ID NO: 6729 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcttcctttgttagtaaattgggcstcaaaaaatccaattttagttcact

SEQ ID NO: 6730 - DNA, 50 bp, Artificial Sequence; identical to SEQ ID NO: 5854
  synthetic Elaeis guineensis (oil palm) single nucleotide polymorphism (SNP) in genomic region adjacent to shatterproof1 (SHELL) shell thickness gene

SEQ ID NO: 6731 - DNA, 50 bp, Artificial Sequence; identical to SEQ ID NO: 5853
  synthetic Elaeis guineensis (oil palm) single nucleotide polymorphism (SNP) in genomic region adjacent to shatterproof1 (SHELL) shell thickness gene

SEQ ID NO: 6732 - DNA, 50 bp, Artificial Sequence; identical to SEQ ID NO: 5852
  synthetic Elaeis guineensis (oil palm) single nucleotide polymorphism (SNP) in genomic region adjacent to shatterproof1 (SHELL) shell thickness gene

SEQ ID NO: 6733 - DNA, 50 bp, Artificial Sequence
  synthetic Elaeis guineensis (oil palm) single nucleotide polymorphism (SNP) in genomic region adjacent to shatterproof1 (SHELL) shell thickness gene
attcctcttcctttgttagtaaatwgggcctcaaaaaatccaattttagt

SEQ ID NO: 6734 - DNA, 50 bp, Artificial Sequence
  synthetic Elaeis guineensis (oil palm) single nucleotide polymorphism (SNP) in genomic region adjacent to shatterproof1 (SHELL) shell thickness gene
atatttgttggctacattatagtaktgtgatgtgttttggcggaaatggg

SEQ ID NO: 6735 - DNA, 50 bp, Artificial Sequence
  synthetic Elaeis guineensis (oil palm) single nucleotide polymorphism (SNP) in genomic region adjacent to shatterproof1 (SHELL) shell thickness gene
atacagaaatcaaggcagaaccctrtttttattttctgttctttgaaact

SEQ ID NO: 6736 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaatttcttcagtctttgagacttrtatctctatgttcttacaattttca

SEQ ID NO: 6737 - DNA, 50 bp, Artificial Sequence
  synthetic Elaeis guineensis (oil palm) single nucleotide polymorphism (SNP) in genomic region adjacent to shatterproof1 (SHELL) shell thickness gene
agacggtgcaatcacggcttgtggygctacggacgtgaaacaggggcgat

SEQ ID NO: 6738 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctccaccttttgctttttttcccgragacccctttttctctctcctttta

SEQ ID NO: 6739 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggtaagtttttagtttcatatttcyttgttttatctctcaaaatgtatac

SEQ ID NO: 6740 - DNA, 50 bp, Artificial Sequence
  synthetic Elaeis guineensis (oil palm) single nucleotide polymorphism (SNP) in genomic region adjacent to shatterproof1 (SHELL) shell thickness gene
agatcagaacacaattataattatrtattggtaagtttttagtttcatat

SEQ ID NO: 6741 - DNA, 50 bp, Artificial Sequence
  synthetic Elaeis guineensis (oil palm) single nucleotide polymorphism (SNP) in genomic region adjacent to shatterproof1 (SHELL) shell thickness gene
cactccaaggtaaatgttgggcatytaggagatgttgtaggtaagtttgg

SEQ ID NO: 6742 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctagagttatattaagttctatgaracatcagatgactagctttactata

SEQ ID NO: 6743 - DNA, 50 bp, Artificial Sequence
  synthetic Elaeis guineensis (oil palm) single nucleotide polymorphism (SNP) in genomic region adjacent to shatterproof1 (SHELL) shell thickness gene
gctcttggccaattagagagtgctycatttctcatcgatcgagtaagtag

SEQ ID NO: 6744 - DNA, 50 bp, Artificial Sequence
  synthetic Elaeis guineensis (oil palm) single nucleotide polymorphism (SNP) in genomic region adjacent to shatterproof1 (SHELL) shell thickness gene
cgtggcccactatttcgactcatcycttccgactccccaagacttcatca

SEQ ID NO: 6745 - DNA, 50 bp, Artificial Sequence
  synthetic Elaeis guineensis (oil palm) single nucleotide polymorphism (SNP) in genomic region adjacent to shatterproof1 (SHELL) shell thickness gene
atgaaaactcttaaatctctactaygtggcccactatttcgactcatctc

SEQ ID NO: 6746 - DNA, 50 bp, Artificial Sequence
  synthetic Elaeis guineensis (oil palm) single nucleotide polymorphism (SNP) in genomic region adjacent to shatterproof1 (SHELL) shell thickness gene
cgatgacccctctttctccctcctyttcctcctcacccccttctcctcgt

SEQ ID NO: 6747 - DNA, 50 bp, Artificial Sequence
  synthetic Elaeis guineensis (oil palm) single nucleotide polymorphism (SNP) in genomic region adjacent to shatterproof1 (SHELL) shell thickness gene
tccaagcccatccatcagccttttstcttcacagtgactccttttatgtc

SEQ ID NO: 6748 - DNA, 50 bp, Artificial Sequence
  synthetic Elaeis guineensis (oil palm) single nucleotide polymorphism (SNP) in genomic region adjacent to shatterproof1 (SHELL) shell thickness gene
aacatccctccttcatcctcctctycttcctcattatccccttctcctct

SEQ ID NO: 6749 - DNA, 50 bp, Artificial Sequence
  synthetic Elaeis guineensis (oil palm) single nucleotide polymorphism (SNP) in genomic region adjacent to shatterproof1 (SHELL) shell thickness gene
gatttgaactctaaatctttggagrcctaaccaaaatcttaatcaataag

SEQ ID NO: 6750 - DNA, 50 bp, Artificial Sequence
  synthetic Elaeis guineensis (oil palm) single nucleotide polymorphism (SNP) in genomic region adjacent to shatterproof1 (SHELL) shell thickness gene
tattaggttcaagtcggatcattgraattcagtaaatctagaccatacct

SEQ ID NO: 6751 - DNA, 50 bp, Artificial Sequence
  synthetic Elaeis guineensis (oil palm) single nucleotide polymorphism (SNP) in genomic region adjacent to shatterproof1 (SHELL) shell thickness gene
gactttgtgtcaagagctaaaacaracattacctaattatgtatttttta

SEQ ID NO: 6752 - DNA, 50 bp, Artificial Sequence
  synthetic Elaeis guineensis (oil palm) single nucleotide polymorphism (SNP) in genomic region adjacent to shatterproof1 (SHELL) shell thickness gene
attagattggattgtcacgagtgaytttggctcgatctggttcattgatt

SEQ ID NO: 6753 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttctctaagatagggtcgacagtgrtaaatgccgaagatttgaccagggc

SEQ ID NO: 6754 - DNA, 50 bp, Artificial Sequence
  synthetic Elaeis guineensis (oil palm) single nucleotide polymorphism (SNP) in genomic region adjacent to shatterproof1 (SHELL) shell thickness gene
cagccctatcattgtcatcttctcyttgagcagcatcggcagcaacatca

SEQ ID NO: 6755 - DNA, 50 bp, Artificial Sequence
  synthetic Elaeis guineensis (oil palm) single nucleotide polymorphism (SNP) in genomic region adjacent to shatterproof1 (SHELL) shell thickness gene
atgacgtccgtagatgtaataggtrtatacttgcatcagcatcacgaact

SEQ ID NO: 6756 - DNA, 50 bp, Artificial Sequence
  synthetic Elaeis guineensis (oil palm) single nucleotide polymorphism (SNP) in genomic region adjacent to shatterproof1 (SHELL) shell thickness gene
actgtgatataaaaatattgctatygacaatggatcgatcgtaccgtacc

SEQ ID NO: 6757 - DNA, 50 bp, Artificial Sequence
  synthetic Elaeis guineensis (oil palm) single nucleotide polymorphism (SNP) in genomic region adjacent to shatterproof1 (SHELL) shell thickness gene
catccaaacccgttacttccaaaayttgaccttcaatttagtatcccatg

SEQ ID NO: 6758 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcaacttcaggactgctctagcttmtattgaaggtatacaagtagcttgc

SEQ ID NO: 6759 - DNA, 50 bp, Artificial Sequence
  synthetic Elaeis guineensis (oil palm) single nucleotide polymorphism (SNP) in genomic region adjacent to shatterproof1 (SHELL) shell thickness gene
tggtggctccactggctcttgtatktttccccccctcaatttaacgaaaa

SEQ ID NO: 6760 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctgcgtcatttattttgatcttcamtttttgccccagaaattcacgagca

SEQ ID NO: 6761 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcatgagccaaatcagcacagaccratataccggaccaataaacgtgatt

SEQ ID NO: 6762 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatgagcacttccaatggatctaamttgtagtgccctaagtaattatgac

SEQ ID NO: 6763 - DNA, 50 bp, Artificial Sequence
  synthetic Elaeis guineensis (oil palm) single nucleotide polymorphism (SNP) in genomic region adjacent to shatterproof1 (SHELL) shell thickness gene
tccacatggttcctggagagttctygggcttccatatgagcacttccaat

SEQ ID NO: 6764 - DNA, 50 bp, Artificial Sequence
  synthetic Elaeis guineensis (oil palm) single nucleotide polymorphism (SNP) in genomic region adjacent to shatterproof1 (SHELL) shell thickness gene
cgtcaattgccttttgactgcagtyggcttggcatcggaatgtttgtgca

SEQ ID NO: 6765 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccgccagatgcaggctgggcctttycacttagctttaacaaattggactt

SEQ ID NO: 6766 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtgggaccaaggaggagtggatggkggtgtgcagtgaatggacgaggggg

SEQ ID NO: 6767 - DNA, 50 bp, Artificial Sequence
  synthetic Elaeis guineensis (oil palm) single nucleotide polymorphism (SNP) in genomic region adjacent to shatterproof1 (SHELL) shell thickness gene
cataagatcagattattgacaaaarttagccatataagagatggattatt

SEQ ID NO: 6768 - DNA, 50 bp, Artificial Sequence
  synthetic Elaeis guineensis (oil palm) single nucleotide polymorphism (SNP) in genomic region adjacent to shatterproof1 (SHELL) shell thickness gene
tccagaattgtacaaagaccgaggwgcacaaactagtgaagtggcaacca

SEQ ID NO: 6769 - DNA, 50 bp, Artificial Sequence
  synthetic Elaeis guineensis (oil palm) single nucleotide polymorphism (SNP) in genomic region adjacent to shatterproof1 (SHELL) shell thickness gene
aattatcagccttttttgaattgtwattgtgttttactcatgcctgatac

SEQ ID NO: 6770 - DNA, 50 bp, Artificial Sequence
  synthetic Elaeis guineensis (oil palm) single nucleotide polymorphism (SNP) in genomic region adjacent to shatterproof1 (SHELL) shell thickness gene
gacaatccatgaagttaattaaaaraaatatgcttttgctatttatagaa

SEQ ID NO: 6771 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagtggttatttagtcaaatccatkcaattatagaattttatatttattt

SEQ ID NO: 6772 - DNA, 50 bp, Artificial Sequence
  synthetic Elaeis guineensis (oil palm) single nucleotide polymorphism (SNP) in genomic region adjacent to shatterproof1 (SHELL) shell thickness gene
tactcatagttaaaatcattaagckatctcttgttacaagatccaacaaa

SEQ ID NO: 6773 - DNA, 50 bp, Artificial Sequence
  synthetic Elaeis guineensis (oil palm) single nucleotide polymorphism (SNP) in genomic region adjacent to shatterproof1 (SHELL) shell thickness gene
atctgttggtttcctcaacttgcayattcaggggagatgactggaagaac

SEQ ID NO: 6774 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctttatctctccctctctttttgckggcgcgcgcctgaaattagtatcct

SEQ ID NO: 6775 - DNA, 50 bp, Artificial Sequence
  synthetic Elaeis guineensis (oil palm) single nucleotide polymorphism (SNP) in genomic region adjacent to shatterproof1 (SHELL) shell thickness gene
actcgttggattgaaaattctaacmatggacttgatctaacctaatccga

SEQ ID NO: 6776 - DNA, 50 bp, Artificial Sequence
  synthetic Elaeis guineensis (oil palm) single nucleotide polymorphism (SNP) in genomic region adjacent to shatterproof1 (SHELL) shell thickness gene
gactcaatccaatccaaatgactcrttggattgaaaattctaaccatgga

SEQ ID NO: 6777 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctggattcaaatcttttggattgamgctggattatatttggactcaatcc

SEQ ID NO: 6778 - DNA, 50 bp, Artificial Sequence
  synthetic Elaeis guineensis (oil palm) single nucleotide polymorphism (SNP) in genomic region adjacent to shatterproof1 (SHELL) shell thickness gene
atatatttaatataaaaatatattyagaattatttttgtatcctaattta

SEQ ID NO: 6779 - DNA, 50 bp, Artificial Sequence
  synthetic Elaeis guineensis (oil palm) single nucleotide polymorphism (SNP) in genomic region adjacent to shatterproof1 (SHELL) shell thickness gene
taaaaaatccatgggactggattargttctaaaattgagtatgttctatt

SEQ ID NO: 6780 - DNA, 50 bp, Artificial Sequence
  synthetic Elaeis guineensis (oil palm) single nucleotide polymorphism (SNP) in genomic region adjacent to shatterproof1 (SHELL) shell thickness gene
gccatatagagtctagacataagarcttcaaatttagagttattttagaa

SEQ ID NO: 6781 - DNA, 50 bp, Artificial Sequence
  synthetic Elaeis guineensis (oil palm) single nucleotide polymorphism (SNP) in genomic region adjacent to shatterproof1 (SHELL) shell thickness gene
attttttaaaaatacaaaagttatytaaataatttacagatatctaaata

SEQ ID NO: 6782 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttaaatttaaactcaaatggatartttttccttatttatcctacatatt

SEQ ID NO: 6783 - DNA, 50 bp, Artificial Sequence
  synthetic Elaeis guineensis (oil palm) single nucleotide polymorphism (SNP) in genomic region adjacent to shatterproof1 (SHELL) shell thickness gene
tagcaattcgaggtaaattcccatsgcggcgccaatatgaagcataagaa

SEQ ID NO: 6784 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttccgtcttatcctgcagctagtrcaggaaatttatgccaaaatggtgt

SEQ ID NO: 6785 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgcatggtaagtatgtatttccgtyttatcctgcagctagtacaggaaat

SEQ ID NO: 6786 - DNA, 50 bp, Artificial Sequence
  synthetic Elaeis guineensis (oil palm) single nucleotide polymorphism (SNP) in genomic region adjacent to shatterproof1 (SHELL) shell thickness gene
tggaaaccatgcatggtaagtatgwatttccgtcttatcctgcagctagt

SEQ ID NO: 6787 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctatcagtaagaagatatagaagcmgaagaaatctctcgcatatcaaata

SEQ ID NO: 6788 - DNA, 50 bp, Artificial Sequence
  synthetic Elaeis guineensis (oil palm) single nucleotide polymorphism (SNP) in genomic region adjacent to shatterproof1 (SHELL) shell thickness gene
tacggattctgttatataaatgaayaggtattgcagttttatgcctcttc

SEQ ID NO: 6789 - DNA, 50 bp, Artificial Sequence
  synthetic Elaeis guineensis (oil palm) single nucleotide polymorphism (SNP) in genomic region adjacent to shatterproof1 (SHELL) shell thickness gene
gatacggattctgttatataaatgwacaggtattgcagttttatgcctct

SEQ ID NO: 6790 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagcaaaacaaccttagatttcagytctgcagatattccaagagcctcag

SEQ ID NO: 6791 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttatctatctttcttgatattaagyatggatgaaagtccaactccgtcaa

SEQ ID NO: 6792 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgaacccataaatgttgattaccawctaataagaggggaaacaaaagaaa

SEQ ID NO: 6793 - DNA, 50 bp, Artificial Sequence
  synthetic Elaeis guineensis (oil palm) single nucleotide polymorphism (SNP) in genomic region adjacent to shatterproof1 (SHELL) shell thickness gene
atctgaactgcaacaagttactatrttatacattaaagaaagaatgaaat

SEQ ID NO: 6794 - DNA, 50 bp, Artificial Sequence
  synthetic Elaeis guineensis (oil palm) single nucleotide polymorphism (SNP) in genomic region adjacent to shatterproof1 (SHELL) shell thickness gene
caccatattttgccagtaacccctrttcagaactgcaaattaacataaag

SEQ ID NO: 6795 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttattttgatagttttaacggctgkttctttggattttcatacctcatcc

SEQ ID NO: 6796 - DNA, 50 bp, Artificial Sequence
  synthetic Elaeis guineensis (oil palm) single nucleotide polymorphism (SNP) in genomic region adjacent to shatterproof1 (SHELL) shell thickness gene
aattatgtgcaagtaaacagaattyataccatgtgttgcaaaaaacacat

SEQ ID NO: 6797 - DNA, 50 bp, Artificial Sequence
  synthetic Elaeis guineensis (oil palm) single nucleotide polymorphism (SNP) in genomic region adjacent to shatterproof1 (SHELL) shell thickness gene
attggaagcaattacgaatacatawaatgtgcaactaaacaaagttcata

SEQ ID NO: 6798 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaatgaaatcagtgtaactcctcamaaaattctgcagaacacagagattt

SEQ ID NO: 6799 - DNA, 50 bp, Artificial Sequence
  synthetic Elaeis guineensis (oil palm) single nucleotide polymorphism (SNP) in genomic region adjacent to shatterproof1 (SHELL) shell thickness gene
agaacagagcctttttactaacaastcacaaagatgagaaaagtcccaag

SEQ ID NO: 6800 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaatgatgggacctacagaacagakcctttttactaacaagtcacaaaga

SEQ ID NO: 6801 - DNA, 50 bp, Artificial Sequence
  synthetic Elaeis guineensis (oil palm) single nucleotide polymorphism (SNP) in genomic region adjacent to shatterproof1 (SHELL) shell thickness gene
agtagcaattggttggatgtggatygggtttgattttatccacactagaa

SEQ ID NO: 6802 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttcgtctttctcttttcgtggtgygcagggaaactgagctggtgggcta

SEQ ID NO: 6803 - DNA, 50 bp, Artificial Sequence
  synthetic Elaeis guineensis (oil palm) single nucleotide polymorphism (SNP) in genomic region adjacent to shatterproof1 (SHELL) shell thickness gene
cgagtgaagccatatggaccccgckaacgccatccacctcgccagcgaat

SEQ ID NO: 6804 - DNA, 50 bp, Artificial Sequence
  synthetic Elaeis guineensis (oil palm) single nucleotide polymorphism (SNP) in genomic region adjacent to shatterproof1 (SHELL) shell thickness gene
aggaaaaataccatgaaagtagttrgcaagctaactaatactatgaaaat

SEQ ID NO: 6805 - DNA, 50 bp, Artificial Sequence
  synthetic Elaeis guineensis (oil palm) single nucleotide polymorphism (SNP) in genomic region adjacent to shatterproof1 (SHELL) shell thickness gene
caatatttctctcacaatcccaacyaaatacaaagaatttgaactaaacg

SEQ ID NO: 6806 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttcccaactctattcaatatttctytcacaatcccaaccaaatacaaaga

SEQ ID NO: 6807 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaattttttgaaccaaatgatagayggagattatctattttcccaactct

SEQ ID NO: 6808 - DNA, 50 bp, Artificial Sequence
  synthetic Elaeis guineensis (oil palm) single nucleotide polymorphism (SNP) in genomic region adjacent to shatterproof1 (SHELL) shell thickness gene
actttctttgtattcccataatttrgaaggatgcaaaattgatgggtcta

SEQ ID NO: 6809 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccatccctctatgttctatccaacyttctttgtattcccataatttggaa

SEQ ID NO: 6810 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaataaataaaaaggtaaaaaagtrtcaggattttacaaaaggttaataa

SEQ ID NO: 6811 - DNA, 50 bp, Artificial Sequence
  synthetic Elaeis guineensis (oil palm) single nucleotide polymorphism (SNP) in genomic region adjacent to shatterproof1 (SHELL) shell thickness gene
tataaataaaataaataaaaaggtmaaaaagtgtcaggattttacaaaag

SEQ ID NO: 6812 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgaaatttaaaaatataagataagyaatatagataaaataaatatatata

SEQ ID NO: 6813 - DNA, 50 bp, Artificial Sequence
  synthetic Elaeis guineensis (oil palm) single nucleotide polymorphism (SNP) in genomic region adjacent to shatterproof1 (SHELL) shell thickness gene
ataattaatttataatttgatttargtagttaactaattttatataaata

SEQ ID NO: 6814 - DNA, 50 bp, Artificial Sequence
  synthetic Elaeis guineensis (oil palm) single nucleotide polymorphism (SNP) in genomic region adjacent to shatterproof1 (SHELL) shell thickness gene
tataaataattaattaaaaataatraatattaataaaaatagagtataat

SEQ ID NO: 6815 - DNA, 50 bp, Artificial Sequence
  synthetic Elaeis guineensis (oil palm) single nucleotide polymorphism (SNP) in genomic region adjacent to shatterproof1 (SHELL) shell thickness gene
tataaatactaaagaagtagagcamtatataaggtacaaatttaaaattt

SEQ ID NO: 6816 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttctcctctatttaatacaagagraatgaaagaaagaatgaatgatatt

SEQ ID NO: 6817 - DNA, 50 bp, Artificial Sequence
  synthetic Elaeis guineensis (oil palm) single nucleotide polymorphism (SNP) in genomic region adjacent to shatterproof1 (SHELL) shell thickness gene
tccattcatcctctcatatatttgrtaaaatataaaaaaatagatgaaaa

SEQ ID NO: 6818 - DNA, 50 bp, Artificial Sequence
  synthetic Elaeis guineensis (oil palm) single nucleotide polymorphism (SNP) in genomic region adjacent to shatterproof1 (SHELL) shell thickness gene
atttatttatactaaagaagtaaayaatatagatacttataatctttgta

SEQ ID NO: 6819 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaataaaaaaatggatgatatttasataatatttttactaaaatatcttt

SEQ ID NO: 6820 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaataaataaaaaaatggatgatmtttagataatatttttactaaaata

SEQ ID NO: 6821 - DNA, 50 bp, Artificial Sequence
  synthetic Elaeis guineensis (oil palm) single nucleotide polymorphism (SNP) in genomic region adjacent to shatterproof1 (SHELL) shell thickness gene
taaaatatgaaaaaatggataaaarttatttcttcttctatttgatataa

SEQ ID NO: 6822 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcaactaacatgcaccactattagyaggtaaatatgctgcacatgaatcc

SEQ ID NO: 6823 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaagcctaagcaacctcataccttrgctcaactaacatgcaccactatta

SEQ ID NO: 6824 - DNA, 50 bp, Artificial Sequence
  synthetic Elaeis guineensis (oil palm) single nucleotide polymorphism (SNP) in genomic region adjacent to shatterproof1 (SHELL) shell thickness gene
caattgttgctcctttaatcatatwtattgagggaagcctaagcaacctc

SEQ ID NO: 6825 - DNA, 50 bp, Artificial Sequence
  synthetic Elaeis guineensis (oil palm) single nucleotide polymorphism (SNP) in genomic region adjacent to shatterproof1 (SHELL) shell thickness gene
atcaccatctctatgatgatcctaygattgagagcaatttatgagttaac

SEQ ID NO: 6826 - DNA, 50 bp, Artificial Sequence
  synthetic Elaeis guineensis (oil palm) single nucleotide polymorphism (SNP) in genomic region adjacent to shatterproof1 (SHELL) shell thickness gene
atcttttggatcgatcaccatctcyatgatgatcctacgattgagagcaa

SEQ ID NO: 6827 - DNA, 50 bp, Artificial Sequence
  synthetic Elaeis guineensis (oil palm) single nucleotide polymorphism (SNP) in genomic region adjacent to shatterproof1 (SHELL) shell thickness gene
cgaagagagtgatcgtacatcaatmttttggatcgatcaccatctctatg

SEQ ID NO: 6828 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgtctgcacaccataaaatcaagaytcatctatccgaagagagtgatcgt

SEQ ID NO: 6829 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcgcttcggtgtctgcacaccataraatcaagactcatctatccgaagag

SEQ ID NO: 6830 - DNA, 50 bp, Artificial Sequence
  synthetic Elaeis guineensis (oil palm) single nucleotide polymorphism (SNP) in genomic region adjacent to shatterproof1 (SHELL) shell thickness gene
taaacacacaaccgcagctatgaayatgccactaatgaaaaagtagatat

SEQ ID NO: 6831 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcgaattatggtgtagtcaaactayagcaccctcaagatgaattgtcgat

SEQ ID NO: 6832 - DNA, 50 bp, Artificial Sequence
  synthetic Elaeis guineensis (oil palm) single nucleotide polymorphism (SNP) in genomic region adjacent to shatterproof1 (SHELL) shell thickness gene
actacagccaacatacaccttaagrctccgtatggctagaaaatcgaatt

SEQ ID NO: 6833 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttaatttctgcaatgaatatactayagccaacatacaccttaagactccg

SEQ ID NO: 6834 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcgagatcgatagatttcatctttrtgcaatttaatttctgcaatgaata

SEQ ID NO: 6835 - DNA, 50 bp, Artificial Sequence
  synthetic Elaeis guineensis (oil palm) single nucleotide polymorphism (SNP) in genomic region adjacent to shatterproof1 (SHELL) shell thickness gene
cttttctatctttcacactgtcatrgctatagatttgtggactcaatttc

SEQ ID NO: 6836 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccagtagaactgaaagatgaatctytaagtatagttaccatgtgattcgg

SEQ ID NO: 6837 - DNA, 50 bp, Artificial Sequence
  synthetic Elaeis guineensis (oil palm) single nucleotide polymorphism (SNP) in genomic region adjacent to shatterproof1 (SHELL) shell thickness gene
agtaacatctagcagtatatagtgrcaatccagtagaactgaaagatgaa

SEQ ID NO: 6838 - DNA, 50 bp, Artificial Sequence
  synthetic Elaeis guineensis (oil palm) single nucleotide polymorphism (SNP) in genomic region adjacent to shatterproof1 (SHELL) shell thickness gene
catgtaggagaaaatgggtttaacyatgtgctagcataactcccttaaac

SEQ ID NO: 6839 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctatctaataggaaacccaaatcawgtaggagaaaatgggtttaactatg

SEQ ID NO: 6840 - DNA, 50 bp, Artificial Sequence
  synthetic Elaeis guineensis (oil palm) single nucleotide polymorphism (SNP) in genomic region adjacent to shatterproof1 (SHELL) shell thickness gene
catggccgaacaacattgggtggcrccaacatttgacgccccataaagcc

SEQ ID NO: 6841 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaatccatatgggtgtgagccctcrtcatggccgaacaacattgggtggc

SEQ ID NO: 6842 - DNA, 50 bp, Artificial Sequence
  synthetic Elaeis guineensis (oil palm) single nucleotide polymorphism (SNP) in genomic region adjacent to shatterproof1 (SHELL) shell thickness gene
tagtagataaggcttatccctctcyctctctcttatctgaatttggatga

SEQ ID NO: 6843 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatctcttatcctcatccactagtrgataaggcttatccctctccctctc

SEQ ID NO: 6844 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttcaaatctaaatttaaattcaaargagatcaaatctcttatcctcatcc

SEQ ID NO: 6845 - DNA, 50 bp, Artificial Sequence
  synthetic Elaeis guineensis (oil palm) single nucleotide polymorphism (SNP) in genomic region adjacent to shatterproof1 (SHELL) shell thickness gene
atcaatgaaaaatttagattggcayggagataggataaggttgttgtcgc

SEQ ID NO: 6846 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgttttgtcacataaaatcaatgaraaatttagattggcacggagatagg

SEQ ID NO: 6847 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttttatacgaatctgatcaaatcakatgtcttaaaataggactcttctag

SEQ ID NO: 6848 - DNA, 50 bp, Artificial Sequence
  synthetic Elaeis guineensis (oil palm) single nucleotide polymorphism (SNP) in genomic region adjacent to shatterproof1 (SHELL) shell thickness gene
gacgtggaagtgcttcatatatcaragatagaagagggaggaggcatgga

SEQ ID NO: 6849 - DNA, 50 bp, Artificial Sequence
  synthetic Elaeis guineensis (oil palm) single nucleotide polymorphism (SNP) in genomic region adjacent to shatterproof1 (SHELL) shell thickness gene
cgaacccactaaatagcgtgtccarcacccttggacgtggaagtgcttca

SEQ ID NO: 6850 - DNA, 50 bp, Artificial Sequence
  synthetic Elaeis guineensis (oil palm) single nucleotide polymorphism (SNP) in genomic region adjacent to shatterproof1 (SHELL) shell thickness gene
atgcaaatttgacagccttcgacayttcgaacccactaaatagcgtgtcc

SEQ ID NO: 6851 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcgaagctagatcacagccttctcrttcttgatgcaaatttgacagcctt

SEQ ID NO: 6852 - DNA, 50 bp, Artificial Sequence
  synthetic Elaeis guineensis (oil palm) single nucleotide polymorphism (SNP) in genomic region adjacent to shatterproof1 (SHELL) shell thickness gene
caggactccgatcgaagctagatcrcagccttctcgttcttgatgcaaat

SEQ ID NO: 6853 - DNA, 50 bp, Artificial Sequence
  synthetic Elaeis guineensis (oil palm) single nucleotide polymorphism (SNP) in genomic region adjacent to shatterproof1 (SHELL) shell thickness gene
tactcgagattcgctgttgagctaygcacgtgactgacctctataggcat

SEQ ID NO: 6854 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccaaatatagatctaaatcagatcmatgaactatttatatcagcatataa

SEQ ID NO: 6855 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgaccagacgatctgatgataaacytttccgaatacttggctactcagat

SEQ ID NO: 6856 - DNA, 50 bp, Artificial Sequence
  synthetic Elaeis guineensis (oil palm) single nucleotide polymorphism (SNP) in genomic region adjacent to shatterproof1 (SHELL) shell thickness gene
tccttgcttcttcttatgaccagaygatctgatgataaacttttccgaat

SEQ ID NO: 6857 - DNA, 50 bp, Artificial Sequence
  synthetic Elaeis guineensis (oil palm) single nucleotide polymorphism (SNP) in genomic region adjacent to shatterproof1 (SHELL) shell thickness gene
cctacacttcataagagaatccatygattggacaagagagggattattcc

SEQ ID NO: 6858 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttcactgttcttctttatgggatrtaaccatatggtgtccctacacttc

SEQ ID NO: 6859 - DNA, 50 bp, Artificial Sequence
  synthetic Elaeis guineensis (oil palm) single nucleotide polymorphism (SNP) in genomic region adjacent to shatterproof1 (SHELL) shell thickness gene
atcaaatacaaatttcttttcactrttcttctttatgggatataaccata

SEQ ID NO: 6860 - DNA, 50 bp, Artificial Sequence
  synthetic Elaeis guineensis (oil palm) single nucleotide polymorphism (SNP) in genomic region adjacent to shatterproof1 (SHELL) shell thickness gene
gatagacgtgccagcagcaggtttyaagattttataaaattttagatttt

SEQ ID NO: 6861 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcaaaaaggactaagttgcctcgayagacgtgccagcagcaggtttcaag

SEQ ID NO: 6862 - DNA, 50 bp, Artificial Sequence
  synthetic Elaeis guineensis (oil palm) single nucleotide polymorphism (SNP) in genomic region adjacent to shatterproof1 (SHELL) shell thickness gene
atcacaggactgagccgactaactrgtgacaaacagtaactcgctaaccg

SEQ ID NO: 6863 - DNA, 50 bp, Artificial Sequence
  synthetic Elaeis guineensis (oil palm) single nucleotide polymorphism (SNP) in genomic region adjacent to shatterproof1 (SHELL) shell thickness gene
atgatttatgaaattatgtcagatytgaattttcaattagatcttttaat

SEQ ID NO: 6864 - DNA, 50 bp, Artificial Sequence
  synthetic Elaeis guineensis (oil palm) single nucleotide polymorphism (SNP) in genomic region adjacent to shatterproof1 (SHELL) shell thickness gene
tagacttaattgagctacccacacyctgaactcatgatttatgaaattat

SEQ ID NO: 6865 - DNA, 50 bp, Artificial Sequence
  synthetic Elaeis guineensis (oil palm) single nucleotide polymorphism (SNP) in genomic region adjacent to shatterproof1 (SHELL) shell thickness gene
acaacggaattaattaaaaaactaycatctatgtacttaccttagacatc

SEQ ID NO: 6866 - DNA, 50 bp, Artificial Sequence
  synthetic Elaeis guineensis (oil palm) single nucleotide polymorphism (SNP) in genomic region adjacent to shatterproof1 (SHELL) shell thickness gene
taatggttataactaatctagtggyatggactagcacaagttcaacaagt

SEQ ID NO: 6867 - DNA, 50 bp, Artificial Sequence
  synthetic Elaeis guineensis (oil palm) single nucleotide polymorphism (SNP) in genomic region adjacent to shatterproof1 (SHELL) shell thickness gene
cgagaacaatcaaccctgtaaaggrcccacacaactacaatgatagaaaa

SEQ ID NO: 6868 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctaatagttatagttgcatctttycgatgcaactgaatcactgtatcca

SEQ ID NO: 6869 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcttgtccaatgtttctctaaacayattgcagccaccttcgatctctaat

SEQ ID NO: 6870 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttaagagtcttaagtgagtactacrgtctcaccaattgactcaccatctc

SEQ ID NO: 6871 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttagggctcctatttttttgattcyccacactcctttagaagagaagcga

SEQ ID NO: 6872 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttggaagcagacattgttcctgcaragagtcaaagtttctaattaaattt

SEQ ID NO: 6873 - DNA, 50 bp, Artificial Sequence
  synthetic Elaeis guineensis (oil palm) single nucleotide polymorphism (SNP) in genomic region adjacent to shatterproof1 (SHELL) shell thickness gene
gatgctttctgatcaacgattggayggattgggagaggagaaaggtcctg

SEQ ID NO: 6874 - DNA, 50 bp, Artificial Sequence
  synthetic Elaeis guineensis (oil palm) single nucleotide polymorphism (SNP) in genomic region adjacent to shatterproof1 (SHELL) shell thickness gene
ataagatgctttctgatcaacgatyggatggattgggagaggagaaaggt

SEQ ID NO: 6875 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctcatgttagtattgtaattcgttrgacattgacgtcaatacatagcacc

SEQ ID NO: 6876 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcaatagtcatatcctcatgttagyattgtaattcgttggacattgacgt

SEQ ID NO: 6877 - DNA, 50 bp, Artificial Sequence
  synthetic Elaeis guineensis (oil palm) single nucleotide polymorphism (SNP) in genomic region adjacent to shatterproof1 (SHELL) shell thickness gene
gttcatatgaatcagtcaaagactrcaggatcagatcaacctacaagtcc

SEQ ID NO: 6878 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcagtagactttctcttgaaaaaartctactccatagcaagtacagagcc

SEQ ID NO: 6879 - DNA, 50 bp, Artificial Sequence
  synthetic Elaeis guineensis (oil palm) single nucleotide polymorphism (SNP) in genomic region adjacent to shatterproof1 (SHELL) shell thickness gene
gttgtctttgtcacagtaaaaataytttctcttttcgacgaccttcttct

SEQ ID NO: 6880 - DNA, 50 bp, Artificial Sequence
  synthetic Elaeis guineensis (oil palm) single nucleotide polymorphism (SNP) in genomic region adjacent to shatterproof1 (SHELL) shell thickness gene
caggtaagtagggcagttccatttycaatggttgtctttgtcacagtaaa

SEQ ID NO: 6881 - DNA, 50 bp, Artificial Sequence
  synthetic Elaeis guineensis (oil palm) single nucleotide polymorphism (SNP) in genomic region adjacent to shatterproof1 (SHELL) shell thickness gene
agtgttgtcaggtaagtagggcagytccatttccaatggttgtctttgtc

SEQ ID NO: 6882 - DNA, 50 bp, Artificial Sequence
  synthetic Elaeis guineensis (oil palm) single nucleotide polymorphism (SNP) in genomic region adjacent to shatterproof1 (SHELL) shell thickness gene
acatccaactggatgtagaaaaaaytgtcagatttatttctatgacgagc

SEQ ID NO: 6883 - DNA, 50 bp, Artificial Sequence
  synthetic Elaeis guineensis (oil palm) single nucleotide polymorphism (SNP) in genomic region adjacent to shatterproof1 (SHELL) shell thickness gene
cctcctactatcctcaagatcctgkaaagaaatgcacaaatgagcactag

SEQ ID NO: 6884 - DNA, 50 bp, Artificial Sequence
  synthetic Elaeis guineensis (oil palm) single nucleotide polymorphism (SNP) in genomic region adjacent to shatterproof1 (SHELL) shell thickness gene
tagaatcatttcactatcccttaayctcctactatcctcaagatcctgta

SEQ ID NO: 6885 - DNA, 50 bp, Artificial Sequence
  synthetic Elaeis guineensis (oil palm) single nucleotide polymorphism (SNP) in genomic region adjacent to shatterproof1 (SHELL) shell thickness gene
atatttttcattagtaatcgtagakgataggttttcacgaccatagtagc

SEQ ID NO: 6886 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcgttaaacaagatacaaaaatcaratttctgctcgcagtagatataaag

SEQ ID NO: 6887 - DNA, 50 bp, Artificial Sequence
  synthetic Elaeis guineensis (oil palm) single nucleotide polymorphism (SNP) in genomic region adjacent to shatterproof1 (SHELL) shell thickness gene
atttcttaaataaatagcacaatgrtccttaaagaaattaattatatagt

SEQ ID NO: 6888 - DNA, 50 bp, Artificial Sequence
  synthetic Elaeis guineensis (oil palm) single nucleotide polymorphism (SNP) in genomic region adjacent to shatterproof1 (SHELL) shell thickness gene
atcatttctaactttattatttctyaaataaatagcacaatgatccttaa

SEQ ID NO: 6889 - DNA, 50 bp, Artificial Sequence
  synthetic Elaeis guineensis (oil palm) single nucleotide polymorphism (SNP) in genomic region adjacent to shatterproof1 (SHELL) shell thickness gene
ataactaaaaaagatcattaataaraaaatcatttctaactttattattt

SEQ ID NO: 6890 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttttcgttcacattatctctaagaygtttagaacctatagcattcacatt

SEQ ID NO: 6891 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttaatcttatcttcggcaacatgayctagccttaggtgccacaagtactt

SEQ ID NO: 6892 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgtcttgaaggtatgattcacagaycgaatatgactcagaagtcaataga

SEQ ID NO: 6893 - DNA, 50 bp, Artificial Sequence
  synthetic Elaeis guineensis (oil palm) single nucleotide polymorphism (SNP) in genomic region adjacent to shatterproof1 (SHELL) shell thickness gene
caccagagcaagtcactctatgatyctttccccaagtctcacaaaagaca

SEQ ID NO: 6894 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccactatgagataattctatttttyttgagataattcaaaaatttttcac

SEQ ID NO: 6895 - DNA, 50 bp, Artificial Sequence
  synthetic Elaeis guineensis (oil palm) single nucleotide polymorphism (SNP) in genomic region adjacent to shatterproof1 (SHELL) shell thickness gene
atgtcgactcacaatcacattatgrtctttcgaaagatagaaataatatc

SEQ ID NO: 6896 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttctaaggctcattgctctttgaaractttctcttcaagtctaatttgtc

SEQ ID NO: 6897 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttggttcctcaagttctaaggctcrttgctctttgaagactttctcttca

SEQ ID NO: 6898 - DNA, 50 bp, Artificial Sequence
  synthetic Elaeis guineensis (oil palm) single nucleotide polymorphism (SNP) in genomic region adjacent to shatterproof1 (SHELL) shell thickness gene
atacactgcaacagcaagcaatgtrcagatggacttaagcataggtataa

SEQ ID NO: 6899 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcctcattattgatgaaaccaaacratttaattacatcactgaactaagc

SEQ ID NO: 6900 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggagaatatcatctatgtacaatayaaagaaagtgatagcactttcattg

SEQ ID NO: 6901 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgttgggacacatcattttggagaratgaatgccatatctgaagggtact

SEQ ID NO: 6902 - DNA, 50 bp, Artificial Sequence
  synthetic Elaeis guineensis (oil palm) single nucleotide polymorphism (SNP) in genomic region adjacent to shatterproof1 (SHELL) shell thickness gene
ataaagaatcttgcttatgcattcratctctttcgatgtgttgggacaca

SEQ ID NO: 6903 - DNA, 50 bp, Artificial Sequence
  synthetic Elaeis guineensis (oil palm) single nucleotide polymorphism (SNP) in genomic region adjacent to shatterproof1 (SHELL) shell thickness gene
gctccctataacggaagcataaagratcttgcttatgcattcaatctctt

SEQ ID NO: 6904 - DNA, 50 bp, Artificial Sequence
  synthetic Elaeis guineensis (oil palm) single nucleotide polymorphism (SNP) in genomic region adjacent to shatterproof1 (SHELL) shell thickness gene
acagtatgagcgatattaggtcgtrtacaaagtatgacgtacatgaggct

SEQ ID NO: 6905 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttttgaaccagaacatctccttcayagcctctaatgcggcgatgtattct

SEQ ID NO: 6906 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcatcactccaagttctgcaataawttttttgaaccagaacatctccttc

SEQ ID NO: 6907 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctttctcaaggtaatcgcggatgargtgaaaccatcgcttgatgtacttg

SEQ ID NO: 6908 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctcacttgacctaaagctaattgrctacaaatctaagttccatcttctc

SEQ ID NO: 6909 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttacagacactattaaacataatrtaaataaaaataacccaattttatt

SEQ ID NO: 6910 - DNA, 50 bp, Artificial Sequence
  synthetic Elaeis guineensis (oil palm) single nucleotide polymorphism (SNP) in genomic region adjacent to shatterproof1 (SHELL) shell thickness gene
cttatgattgagagtaatttatgarttaactaagattagtatatgtttca

SEQ ID NO: 6911 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcttttggatcgatcaccatctccrtgatgatcttatgattgagagtaat

SEQ ID NO: 6912 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcaagactcatctatccgaagagartgatcatacatcaatcttttggatc

SEQ ID NO: 6913 - DNA, 50 bp, Artificial Sequence
  synthetic Elaeis guineensis (oil palm) single nucleotide polymorphism (SNP) in genomic region adjacent to shatterproof1 (SHELL) shell thickness gene
actcagtactcttgctcttaacaarcacctatactttcactccgatgtct

SEQ ID NO: 6914 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttcaattcttacaatgaacatactrgagccaacatacatctcaagactcc

SEQ ID NO: 6915 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttgaaagataaacttctagatacarttatcgtgtgattcgattcttctat

SEQ ID NO: 6916 - DNA, 50 bp, Artificial Sequence
  synthetic Elaeis guineensis (oil palm) single nucleotide polymorphism (SNP) in genomic region adjacent to shatterproof1 (SHELL) shell thickness gene
gatcccacaatccatcagtgacacycagcaatatgtagtggcaacctagc

SEQ ID NO: 6917 - DNA, 50 bp, Artificial Sequence
  synthetic Elaeis guineensis (oil palm) single nucleotide polymorphism (SNP) in genomic region adjacent to shatterproof1 (SHELL) shell thickness gene
aacaacatcatcgaaactcttttcratagatcagaactcttttcaattca

SEQ ID NO: 6918 - DNA, 50 bp, Artificial Sequence
  synthetic Elaeis guineensis (oil palm) single nucleotide polymorphism (SNP) in genomic region adjacent to shatterproof1 (SHELL) shell thickness gene
agcatgattttcttaaattcaaaaytaggactcaattgatcctaatccaa

SEQ ID NO: 6919 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttaaccatgtgctagcatgatttycttaaattcaaaactaggactcaat

SEQ ID NO: 6920 - DNA, 50 bp, Artificial Sequence
  synthetic Elaeis guineensis (oil palm) single nucleotide polymorphism (SNP) in genomic region adjacent to shatterproof1 (SHELL) shell thickness gene
catggtcgaacaatattgggtggcrccaacatttgacgcctcgtaaaccc

SEQ ID NO: 6921 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctttgatttttctcttgttttatcrtacaaaactaataaaaaattcagac

SEQ ID NO: 6922 - DNA, 50 bp, Artificial Sequence
  synthetic Elaeis guineensis (oil palm) single nucleotide polymorphism (SNP) in genomic region adjacent to shatterproof1 (SHELL) shell thickness gene
aacagaaggactctcttagatccaycctactttgatttttctcttgtttt

SEQ ID NO: 6923 - DNA, 50 bp, Artificial Sequence
  synthetic Elaeis guineensis (oil palm) single nucleotide polymorphism (SNP) in genomic region adjacent to shatterproof1 (SHELL) shell thickness gene
atgccttaaaacagaaggactctcytagatccaccctactttgatttttc

SEQ ID NO: 6924 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatcataaagaatctctttttataygaatctgatcaaatcagatgcctta

SEQ ID NO: 6925 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttctagtttcttatgcagttttgayggctttcgatacttcgaacccacca

SEQ ID NO: 6926 - DNA, 50 bp, Artificial Sequence
  synthetic Elaeis guineensis (oil palm) single nucleotide polymorphism (SNP) in genomic region adjacent to shatterproof1 (SHELL) shell thickness gene
acctagacggatccgcaagctcctygatcagattcaaatctgatctccaa

SEQ ID NO: 6927 - DNA, 50 bp, Artificial Sequence
  synthetic Elaeis guineensis (oil palm) single nucleotide polymorphism (SNP) in genomic region adjacent to shatterproof1 (SHELL) shell thickness gene
cgtccgactcacaagtatccactcragcctggtctgagatgctctctcct

SEQ ID NO: 6928 - DNA, 50 bp, Artificial Sequence
  synthetic Elaeis guineensis (oil palm) single nucleotide polymorphism (SNP) in genomic region adjacent to shatterproof1 (SHELL) shell thickness gene
atgcatacgtccgactcacaagtayccactcgagcctggtctgagatgct

SEQ ID NO: 6929 - DNA, 50 bp, Artificial Sequence
  synthetic Elaeis guineensis (oil palm) single nucleotide polymorphism (SNP) in genomic region adjacent to shatterproof1 (SHELL) shell thickness gene
agtccgataatcagagtatccaagrttcactgttcagccatgcatacgtc

SEQ ID NO: 6930 - DNA, 50 bp, Artificial Sequence
  synthetic Elaeis guineensis (oil palm) single nucleotide polymorphism (SNP) in genomic region adjacent to shatterproof1 (SHELL) shell thickness gene
agatcaataaactatttatatcagyatataaatataaaacaacatgcaaa

SEQ ID NO: 6931 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaggcagtagaattcaaaaattttygatccgacccggtacatcaaacata

SEQ ID NO: 6932 - DNA, 50 bp, Artificial Sequence
  synthetic Elaeis guineensis (oil palm) single nucleotide polymorphism (SNP) in genomic region adjacent to shatterproof1 (SHELL) shell thickness gene
taagaaaggagaccgacggagaccracgagaggtggcatcaagcagagaa

SEQ ID NO: 6933 - DNA, 50 bp, Artificial Sequence
  synthetic Elaeis guineensis (oil palm) single nucleotide polymorphism (SNP) in genomic region adjacent to shatterproof1 (SHELL) shell thickness gene
aggtggccgttcgtgagagctcgayaagaaaggagaccgacggagaccga

SEQ ID NO: 6934 - DNA, 50 bp, Artificial Sequence
  synthetic Elaeis guineensis (oil palm) single nucleotide polymorphism (SNP) in genomic region adjacent to shatterproof1 (SHELL) shell thickness gene
acggacaaaggggtgcggacggtcrtcggtgctcacacacaactgcaggg

SEQ ID NO: 6935 - DNA, 50 bp, Artificial Sequence
  synthetic Elaeis guineensis (oil palm) single nucleotide polymorphism (SNP) in genomic region adjacent to shatterproof1 (SHELL) shell thickness gene
cttttaatatcctgccaaagccagrtaagaaaataatatttttaattaat

SEQ ID NO: 6936 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttttattatcttatatcagtgaatrattaatttcaacaaaataattacaa

SEQ ID NO: 6937 - DNA, 50 bp, Artificial Sequence
  synthetic Elaeis guineensis (oil palm) single nucleotide polymorphism (SNP) in genomic region adjacent to shatterproof1 (SHELL) shell thickness gene
tacacaatataaagaatagaatacyagttatcataacaatcattcagaaa

SEQ ID NO: 6938 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatggatttctgaaacaacaattcrgagaatatcaactgcatagtaattc

SEQ ID NO: 6939 - DNA, 50 bp, Artificial Sequence
  synthetic Elaeis guineensis (oil palm) single nucleotide polymorphism (SNP) in genomic region adjacent to shatterproof1 (SHELL) shell thickness gene
aacagtgcaaaaagaagcaacaatraataagaaagaacaatttcacatct

SEQ ID NO: 6940 - DNA, 50 bp, Artificial Sequence
  synthetic Elaeis guineensis (oil palm) single nucleotide polymorphism (SNP) in genomic region adjacent to shatterproof1 (SHELL) shell thickness gene
atccaaaaacaagcttgtccaagcwcggtctatttagcaaattagtcgaa

SEQ ID NO: 6941 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatttaagggaaagtagcttgtcartagggcgaaagacaagcaaagatat

SEQ ID NO: 6942 - DNA, 50 bp, Artificial Sequence
  synthetic Elaeis guineensis (oil palm) single nucleotide polymorphism (SNP) in genomic region adjacent to shatterproof1 (SHELL) shell thickness gene
atcagagcataggtttccacaacakaccaacactatatgcaccaacttac

SEQ ID NO: 6943 - DNA, 50 bp, Artificial Sequence
  synthetic Elaeis guineensis (oil palm) single nucleotide polymorphism (SNP) in genomic region adjacent to shatterproof1 (SHELL) shell thickness gene
acaaaatgcaatgagcgatcttctsgttcgtggctctcacaaggcatgca

SEQ ID NO: 6944 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctcactaattaaatacttgcagagrctggagaccagctcccacgatgatc

SEQ ID NO: 6945 - DNA, 50 bp, Artificial Sequence
  synthetic Elaeis guineensis (oil palm) single nucleotide polymorphism (SNP) in genomic region adjacent to shatterproof1 (SHELL) shell thickness gene
taaaaaatataaaaataataatatraaatattttaaatattttttataat

SEQ ID NO: 6946 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggaagaagaaaaagataataataawaaaatattattttttaaaaaataaa

SEQ ID NO: 6947 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggtggcgggtccgaagaagcaaggycgggcataggaaggaagaagaaaaa

SEQ ID NO: 6948 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggggacagaggaggcgcaggtagcrcggacagggggtggagggggtggcg

SEQ ID NO: 6949 - DNA, 50 bp, Artificial Sequence
  synthetic Elaeis guineensis (oil palm) single nucleotide polymorphism (SNP) in genomic region adjacent to shatterproof1 (SHELL) shell thickness gene
gacgtcggaggtggaggaaccgcargtgtgcagggctaggggagtattgc

SEQ ID NO: 6950 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagattacgattaattcatgtcacrattaaattaattttttttctaaaaa

SEQ ID NO: 6951 - DNA, 50 bp, Artificial Sequence
  synthetic Elaeis guineensis (oil palm) single nucleotide polymorphism (SNP) in genomic region adjacent to shatterproof1 (SHELL) shell thickness gene
attttttatcattaaattaaacatraattatttagatttcaactaattaa

SEQ ID NO: 6952 - DNA, 50 bp, Artificial Sequence
  synthetic Elaeis guineensis (oil palm) single nucleotide polymorphism (SNP) in genomic region adjacent to shatterproof1 (SHELL) shell thickness gene
agtactccggaagatattttagttyctttattgtttatctattttttatc

SEQ ID NO: 6953 - DNA, 50 bp, Artificial Sequence
  synthetic Elaeis guineensis (oil palm) single nucleotide polymorphism (SNP) in genomic region adjacent to shatterproof1 (SHELL) shell thickness gene
atgtgtaatacatgtcctaattaaraattttactatagtactccggaaga

SEQ ID NO: 6954 - DNA, 50 bp, Artificial Sequence
  synthetic Elaeis guineensis (oil palm) single nucleotide polymorphism (SNP) in genomic region adjacent to shatterproof1 (SHELL) shell thickness gene
acaacatcattcctcttttcttttyttttttttaactattttacttcatt

SEQ ID NO: 6955 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccttacccttaccagagcaagttcrttcctttattttctctttagttatt

SEQ ID NO: 6956 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgctttttcactttctaaccgacarcactttcatccttacccttaccaga

SEQ ID NO: 6957 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaacaaaatatctaattaatataraaagttactcaacagaatggaattc

SEQ ID NO: 6958 - DNA, 50 bp, Artificial Sequence
  synthetic Elaeis guineensis (oil palm) single nucleotide polymorphism (SNP) in genomic region adjacent to shatterproof1 (SHELL) shell thickness gene
aattattataatttaatcaaaaatyagaaattgatggtgaatatggaata

SEQ ID NO: 6959 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctcgaacatttcctcgttgtaagawccaggtgagtactgcagagcgccgt

SEQ ID NO: 6960 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagctgatgagaagaagttgccatrtgatatatgggcattatatatatgt

SEQ ID NO: 6961 - DNA, 50 bp, Artificial Sequence
  synthetic Elaeis guineensis (oil palm) single nucleotide polymorphism (SNP) in genomic region adjacent to shatterproof1 (SHELL) shell thickness gene
atatatatatatatatgaatcaatmcatatctacccataccatatgcgtg

SEQ ID NO: 6962 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctaacaaaggttagggctttattamttgtcagtgcaaatatcttgtcatg

SEQ ID NO: 6963 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttgggagtgtacctaacaaaggttwgggctttattaattgtcagtgcaaa

SEQ ID NO: 6964 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccttcactcttaccaacatgatgastgaacctgactcttcttttgttgag

SEQ ID NO: 6965 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctgattaatgaattccttcactctyaccaacatgatgagtgaacctgact

SEQ ID NO: 6966 - DNA, 50 bp, Artificial Sequence
  synthetic Elaeis guineensis (oil palm) single nucleotide polymorphism (SNP) in genomic region adjacent to shatterproof1 (SHELL) shell thickness gene
ataccataatatcttccatagttgraagcacatcagctctctcaagatgc

SEQ ID NO: 6967 - DNA, 50 bp, Artificial Sequence
  synthetic Elaeis guineensis (oil palm) single nucleotide polymorphism (SNP) in genomic region adjacent to shatterproof1 (SHELL) shell thickness gene
taaccaatgtagaaccagtgatctyctttcttctataccataatatcttc

SEQ ID NO: 6968 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctttctatataagctaaatttttcyttaactctaaccaatgtagaaccag

SEQ ID NO: 6969 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagccttgatcattgagagcctcaygattttattctttaaaaagcatctc

SEQ ID NO: 6970 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatggtgtttaggtgaaaggagccycccacattctattaaaggcatgttg

SEQ ID NO: 6971 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctttgggaacataacctctctagtsaaaggagaatctgtgtactctacag

SEQ ID NO: 6972 - DNA, 50 bp, Artificial Sequence
  synthetic Elaeis guineensis (oil palm) single nucleotide polymorphism (SNP) in genomic region adjacent to shatterproof1 (SHELL) shell thickness gene
gactcaagatcaagtagcagacatmttcaccaagatattacccaaagaga

SEQ ID NO: 6973 - DNA, 50 bp, Artificial Sequence
  synthetic Elaeis guineensis (oil palm) single nucleotide polymorphism (SNP) in genomic region adjacent to shatterproof1 (SHELL) shell thickness gene
tggatgagaagcaagaagaagctaytatactactttgtgacaataagttt

SEQ ID NO: 6974 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgtggatgagaagcaagaagaagcyattatactactttgtgacaataagt

SEQ ID NO: 6975 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgagaagaatactagaagatgtggrtgagaagcaagaagaagctattata

SEQ ID NO: 6976 - DNA, 50 bp, Artificial Sequence
  synthetic Elaeis guineensis (oil palm) single nucleotide polymorphism (SNP) in genomic region adjacent to shatterproof1 (SHELL) shell thickness gene
aacatcaaagaagcaagacattgtrgtattgtcatccacgaaagtcgaat

SEQ ID NO: 6977 - DNA, 50 bp, Artificial Sequence
  synthetic Elaeis guineensis (oil palm) single nucleotide polymorphism (SNP) in genomic region adjacent to shatterproof1 (SHELL) shell thickness gene
atcttgaacatcaaagaagcaagayattgtggtattgtcatccacgaaag

SEQ ID NO: 6978 - DNA, 50 bp, Artificial Sequence
  synthetic Elaeis guineensis (oil palm) single nucleotide polymorphism (SNP) in genomic region adjacent to shatterproof1 (SHELL) shell thickness gene
agtcaagtaaggttcactttggagkggcacaaagagtcttgagatacatc

SEQ ID NO: 6979 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttctagattcatgcaaaagtcaagyaaggttcactttggagtggcacaaa

SEQ ID NO: 6980 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaagttaatgaaaaaagatgaaagygatgaagccaatgcaccactatata

SEQ ID NO: 6981 - DNA, 50 bp, Artificial Sequence
  synthetic Elaeis guineensis (oil palm) single nucleotide polymorphism (SNP) in genomic region adjacent to shatterproof1 (SHELL) shell thickness gene
caaaacggagaattacaatattgtrgtaacacctttgatggtaaatgaga

SEQ ID NO: 6982 - DNA, 50 bp, Artificial Sequence
  synthetic Elaeis guineensis (oil palm) single nucleotide polymorphism (SNP) in genomic region adjacent to shatterproof1 (SHELL) shell thickness gene
agatagtattgttatttatcaaaaraagtatgtagaaagcattctcaaga

SEQ ID NO: 6983 - DNA, 50 bp, Artificial Sequence
  synthetic Elaeis guineensis (oil palm) single nucleotide polymorphism (SNP) in genomic region adjacent to shatterproof1 (SHELL) shell thickness gene
actttttagaaattgaaatcatgcygagagaagatagtattgttatttat

SEQ ID NO: 6984 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaagtttttaaagaagttcaagtraaccaacactttatatgaagaagta

SEQ ID NO: 6985 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatgagaaaagtttttaaagaagtycaagtgaaccaacactttatatgaa

SEQ ID NO: 6986 - DNA, 50 bp, Artificial Sequence
  synthetic Elaeis guineensis (oil palm) single nucleotide polymorphism (SNP) in genomic region adjacent to shatterproof1 (SHELL) shell thickness gene
attgaagccaacttcaatgagaaargtttttaaagaagttcaagtgaacc

SEQ ID NO: 6987 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaggaaaaaatttatatagaacaayctcaaggcttcatcatcaaaggtca

SEQ ID NO: 6988 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttcttgaatgggatattggaggaaraaatttatatagaacaacctcaagg

SEQ ID NO: 6989 - DNA, 50 bp, Artificial Sequence
  synthetic Elaeis guineensis (oil palm) single nucleotide polymorphism (SNP) in genomic region adjacent to shatterproof1 (SHELL) shell thickness gene
acaactagacctctcatttctatgrtggcatacaaagattggaaactaca

SEQ ID NO: 6990 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatccagaattaattatcaaaaaawttttgcaccgattgctcaacatgac

SEQ ID NO: 6991 - DNA, 50 bp, Artificial Sequence
  synthetic Elaeis guineensis (oil palm) single nucleotide polymorphism (SNP) in genomic region adjacent to shatterproof1 (SHELL) shell thickness gene
agcaaaattagtagaaaaaggatamtctcaactatccagaattaattatc

SEQ ID NO: 6992 - DNA, 50 bp, Artificial Sequence
  synthetic Elaeis guineensis (oil palm) single nucleotide polymorphism (SNP) in genomic region adjacent to shatterproof1 (SHELL) shell thickness gene
gacaaaatacaatccggatggatcyattcaaagatacaaagcaaaattag

SEQ ID NO: 6993 - DNA, 50 bp, Artificial Sequence
  synthetic Elaeis guineensis (oil palm) single nucleotide polymorphism (SNP) in genomic region adjacent to shatterproof1 (SHELL) shell thickness gene
agaataagacaatgcaagaagaaawtgatgtgattgagaagaacaaaact

SEQ ID NO: 6994 - DNA, 50 bp, Artificial Sequence
  synthetic Elaeis guineensis (oil palm) single nucleotide polymorphism (SNP) in genomic region adjacent to shatterproof1 (SHELL) shell thickness gene
atacatgaagtagtatagaataagrcaatgcaagaagaaattgatgtgat

SEQ ID NO: 6995 - DNA, 50 bp, Artificial Sequence
  synthetic Elaeis guineensis (oil palm) single nucleotide polymorphism (SNP) in genomic region adjacent to shatterproof1 (SHELL) shell thickness gene
taagtgacatttatgtcacttgtarcttttgcatgattgagcccaaaact

SEQ ID NO: 6996 - DNA, 50 bp, Artificial Sequence
  synthetic Elaeis guineensis (oil palm) single nucleotide polymorphism (SNP) in genomic region adjacent to shatterproof1 (SHELL) shell thickness gene
tataagaataagaagcctaagtgayatttatgtcacttgtagcttttgca

SEQ ID NO: 6997 - DNA, 50 bp, Artificial Sequence
  synthetic Elaeis guineensis (oil palm) single nucleotide polymorphism (SNP) in genomic region adjacent to shatterproof1 (SHELL) shell thickness gene
actcaagcttatctccaaattccaytcctataagaataagaagcctaagt

SEQ ID NO: 6998 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaaaatgaagatgaaggttcaccayaaacttctcaaagtgtaagtccatc

SEQ ID NO: 6999 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctatagactttttagttcgaagcayaacaagatgatcataaaaagagata

SEQ ID NO: 7000 - DNA, 50 bp, Artificial Sequence
  synthetic Elaeis guineensis (oil palm) single nucleotide polymorphism (SNP) in genomic region adjacent to shatterproof1 (SHELL) shell thickness gene
atagttctaaatcaaaaggctataractttttagttcgaagcacaacaag

SEQ ID NO: 7001 - DNA, 50 bp, Artificial Sequence
  synthetic Elaeis guineensis (oil palm) single nucleotide polymorphism (SNP) in genomic region adjacent to shatterproof1 (SHELL) shell thickness gene
aggcacaaacttgatgaagtaagtraaaaatatatttttgttggctatag

SEQ ID NO: 7002 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagcatttcaaagtttttggatgtrtatactatactcgtgttccaaaaga

SEQ ID NO: 7003 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcaaataaatttgaaaaattttatraaaatattggtttgcaaagataatt

SEQ ID NO: 7004 - DNA, 50 bp, Artificial Sequence
  synthetic Elaeis guineensis (oil palm) single nucleotide polymorphism (SNP) in genomic region adjacent to shatterproof1 (SHELL) shell thickness gene
agaggtggtgaatataactcaaatraatttgaaaaattttataaaaatat

SEQ ID NO: 7005 - DNA, 50 bp, Artificial Sequence
  synthetic Elaeis guineensis (oil palm) single nucleotide polymorphism (SNP) in genomic region adjacent to shatterproof1 (SHELL) shell thickness gene
atgatatgggcatactttatgagayataagtttgagacattcatcatctt

SEQ ID NO: 7006 - DNA, 50 bp, Artificial Sequence
  synthetic Elaeis guineensis (oil palm) single nucleotide polymorphism (SNP) in genomic region adjacent to shatterproof1 (SHELL) shell thickness gene
taactacttaaaaatgatatgggcrtactttatgagatataagtttgaga

SEQ ID NO: 7007 - DNA, 50 bp, Artificial Sequence
  synthetic Elaeis guineensis (oil palm) single nucleotide polymorphism (SNP) in genomic region adjacent to shatterproof1 (SHELL) shell thickness gene
acaagcttttctcttttcttcaacmcccccaagagaacctaagcctctag

SEQ ID NO: 7008 - DNA, 50 bp, Artificial Sequence
  synthetic Elaeis guineensis (oil palm) single nucleotide polymorphism (SNP) in genomic region adjacent to shatterproof1 (SHELL) shell thickness gene
tagctgcctggatgggtcggtgggyagcagtacttgaactaaaagctgcc

SEQ ID NO: 7009 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttgactcccaagtatcagacatcaraagtgtgtgatcttctctcttctaa

SEQ ID NO: 7010 - DNA, 50 bp, Artificial Sequence
  synthetic Elaeis guineensis (oil palm) single nucleotide polymorphism (SNP) in genomic region adjacent to shatterproof1 (SHELL) shell thickness gene
atcagcatctctcagtatacgataraaatcatcactgccagcttctagat

SEQ ID NO: 7011 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcacaaattcactcctatataaatrgacagtcattgtatccctatcaagt

SEQ ID NO: 7012 - DNA, 50 bp, Artificial Sequence
  synthetic Elaeis guineensis (oil palm) single nucleotide polymorphism (SNP) in genomic region adjacent to shatterproof1 (SHELL) shell thickness gene
atctcttataagggcaataagtccrtccttgatgtaagagtgccgcattt

SEQ ID NO: 7013 - DNA, 50 bp, Artificial Sequence
  synthetic Elaeis guineensis (oil palm) single nucleotide polymorphism (SNP) in genomic region adjacent to shatterproof1 (SHELL) shell thickness gene
agaaatcatcttgtcaattacttgrcggtccatgacacactacctaagga

SEQ ID NO: 7014 - DNA, 50 bp, Artificial Sequence
  synthetic Elaeis guineensis (oil palm) single nucleotide polymorphism (SNP) in genomic region adjacent to shatterproof1 (SHELL) shell thickness gene
acggtccatgacacactacctaagrattttgcacatacaaatacaagata

SEQ ID NO: 7015 - DNA, 50 bp, Artificial Sequence
  synthetic Elaeis guineensis (oil palm) single nucleotide polymorphism (SNP) in genomic region adjacent to shatterproof1 (SHELL) shell thickness gene
gattttgcacatacaaatacaagayaattgctaaatgattattttattat

SEQ ID NO: 7016 - DNA, 50 bp, Artificial Sequence
  synthetic Elaeis guineensis (oil palm) single nucleotide polymorphism (SNP) in genomic region adjacent to shatterproof1 (SHELL) shell thickness gene
tattatttcgaatggcttatatagwaattacatcttgccatcaactaata

SEQ ID NO: 7017 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcttgccatcaactaataggtatasaaggtcttatctcgttcaaaaatta

SEQ ID NO: 7018 - DNA, 50 bp, Artificial Sequence
  synthetic Elaeis guineensis (oil palm) single nucleotide polymorphism (SNP) in genomic region adjacent to shatterproof1 (SHELL) shell thickness gene
aataggtatagaaggtcttatctcrttcaaaaattatattaattctataa

SEQ ID NO: 7019 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccctatcatttgattactgtaatgrcctataaaattaattgtatttctca

SEQ ID NO: 7020 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctgtaatgacctataaaattaattrtatttctcaaattatccatactgga

SEQ ID NO: 7021 - DNA, 50 bp, Artificial Sequence
  synthetic Elaeis guineensis (oil palm) single nucleotide polymorphism (SNP) in genomic region adjacent to shatterproof1 (SHELL) shell thickness gene
atttctcaaattatccatactggamaatcaattgatcaatgtatataatt

SEQ ID NO: 7022 - DNA, 50 bp, Artificial Sequence
  synthetic Elaeis guineensis (oil palm) single nucleotide polymorphism (SNP) in genomic region adjacent to shatterproof1 (SHELL) shell thickness gene
aattctttcatctgtataagaatayataaatatatagatactgtagaata

SEQ ID NO: 7023 - DNA, 50 bp, Artificial Sequence
  synthetic Elaeis guineensis (oil palm) single nucleotide polymorphism (SNP) in genomic region adjacent to shatterproof1 (SHELL) shell thickness gene
agaatacataaatatatagatactrtagaatatatatattaattaaaaga

SEQ ID NO: 7024 - DNA, 50 bp, Artificial Sequence
  synthetic Elaeis guineensis (oil palm) single nucleotide polymorphism (SNP) in genomic region adjacent to shatterproof1 (SHELL) shell thickness gene
acatgtagacttgggtgcaccagaygactagaccgtgctagcacaccagc

SEQ ID NO: 7025 - DNA, 50 bp, Artificial Sequence
  synthetic Elaeis guineensis (oil palm) single nucleotide polymorphism (SNP) in genomic region adjacent to shatterproof1 (SHELL) shell thickness gene
gggtgcaccagatgactagaccgtrctagcacaccagcatggcatctagg

SEQ ID NO: 7026 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgactagaccgtgctagcacaccarcatggcatctaggcaaattccatcc

SEQ ID NO: 7027 - DNA, 50 bp, Artificial Sequence
  synthetic Elaeis guineensis (oil palm) single nucleotide polymorphism (SNP) in genomic region adjacent to shatterproof1 (SHELL) shell thickness gene
actttagaccaggcttaggccctaraatcttttaaaatatgagatccgag

SEQ ID NO: 7028 - DNA, 50 bp, Artificial Sequence
  synthetic Elaeis guineensis (oil palm) single nucleotide polymorphism (SNP) in genomic region adjacent to shatterproof1 (SHELL) shell thickness gene
atcttttaaaatatgagatccgagyccggctcaaacccaatcagatcggc

SEQ ID NO: 7029 - DNA, 50 bp, Artificial Sequence
  synthetic Elaeis guineensis (oil palm) single nucleotide polymorphism (SNP) in genomic region adjacent to shatterproof1 (SHELL) shell thickness gene
atccccaagggatagatattctctrtcggaagtacattgatcatcgaaga

SEQ ID NO: 7030 - DNA, 50 bp, Artificial Sequence
  synthetic Elaeis guineensis (oil palm) single nucleotide polymorphism (SNP) in genomic region adjacent to shatterproof1 (SHELL) shell thickness gene
cgaagaactcactagaagtacattkgtcatcgaagaactcactaagttgc

SEQ ID NO: 7031 - DNA, 50 bp, Artificial Sequence
  synthetic Elaeis guineensis (oil palm) single nucleotide polymorphism (SNP) in genomic region adjacent to shatterproof1 (SHELL) shell thickness gene
actaagttgcttccaccaccatcgragtagatgagcagggtagagtcggt

SEQ ID NO: 7032 - DNA, 50 bp, Artificial Sequence
  synthetic Elaeis guineensis (oil palm) single nucleotide polymorphism (SNP) in genomic region adjacent to shatterproof1 (SHELL) shell thickness gene
gacgccgtcgctaatactcaccaartggcgcaaagaagaagaggagacgg

SEQ ID NO: 7033 - DNA, 50 bp, Artificial Sequence
  synthetic Elaeis guineensis (oil palm) single nucleotide polymorphism (SNP) in genomic region adjacent to shatterproof1 (SHELL) shell thickness gene
tggcgcaaagaagaagaggagacgrcgtagagattggggcgtgggtctga

SEQ ID NO: 7034 - DNA, 50 bp, Artificial Sequence
  synthetic Elaeis guineensis (oil palm) single nucleotide polymorphism (SNP) in genomic region adjacent to shatterproof1 (SHELL) shell thickness gene
aggatggtcaattcggtgcggggaygtcagatccaaggaggggatgacag

SEQ ID NO: 7035 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttttagggcatagtattagtgatrgctaatttgcatcgctaaagtcttc

SEQ ID NO: 7036 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgatagctaatttgcatcgctaaartcttcactaatactaattatttaaa

SEQ ID NO: 7037 - DNA, 50 bp, Artificial Sequence
  synthetic Elaeis guineensis (oil palm) single nucleotide polymorphism (SNP) in genomic region adjacent to shatterproof1 (SHELL) shell thickness gene
taaaattaaatttataatgatgcaraaaagatcatcgctaataagtcttc

SEQ ID NO: 7038 - DNA, 50 bp, Artificial Sequence
  synthetic Elaeis guineensis (oil palm) single nucleotide polymorphism (SNP) in genomic region adjacent to shatterproof1 (SHELL) shell thickness gene
catcgctaataagtcttcacccttrtaatgatggatttaatttccatcgt

SEQ ID NO: 7039 - DNA, 50 bp, Artificial Sequence
  synthetic Elaeis guineensis (oil palm) single nucleotide polymorphism (SNP) in genomic region adjacent to shatterproof1 (SHELL) shell thickness gene
acccttataatgatggatttaattyccatcgtaataagtagttgataaat

SEQ ID NO: 7040 - DNA, 50 bp, Artificial Sequence
  synthetic Elaeis guineensis (oil palm) single nucleotide polymorphism (SNP) in genomic region adjacent to shatterproof1 (SHELL) shell thickness gene
attactattagcgatggcttatttrccgtcgctattacactattttctta

SEQ ID NO: 7041 - DNA, 50 bp, Artificial Sequence
  synthetic Elaeis guineensis (oil palm) single nucleotide polymorphism (SNP) in genomic region adjacent to shatterproof1 (SHELL) shell thickness gene
caagcaacggagtagtctttgaaaraataataccctacaagccaatcaca

SEQ ID NO: 7042 - DNA, 50 bp, Artificial Sequence
  synthetic Elaeis guineensis (oil palm) single nucleotide polymorphism (SNP) in genomic region adjacent to shatterproof1 (SHELL) shell thickness gene
gccaatcacatatgagatatgatgraattttttttatattttatcttcca

SEQ ID NO: 7043 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaaattttttttatattttatcttycaaacttatgtatttgacattgtta

SEQ ID NO: 7044 - DNA, 50 bp, Artificial Sequence
  synthetic Elaeis guineensis (oil palm) single nucleotide polymorphism (SNP) in genomic region adjacent to shatterproof1 (SHELL) shell thickness gene
taggtctggacaatgattttaggaycacaatgagatcacgtcaatgagat

SEQ ID NO: 7045 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggatggttgatcttataactacttrtgtagtgacactaatataaaaatat

SEQ ID NO: 7046 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaatgagttcactgaattgacctaygagagaatatctaatggagtcttat

SEQ ID NO: 7047 - DNA, 50 bp, Artificial Sequence
  synthetic Elaeis guineensis (oil palm) single nucleotide polymorphism (SNP) in genomic region adjacent to shatterproof1 (SHELL) shell thickness gene
gttcactttctaacttgattttttratctttatgtagggtgttctggatg

SEQ ID NO: 7048 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctggatgtagtgaagtgtgtatgragattgtgagtggtcaataaggaat

SEQ ID NO: 7049 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatgatttcatgcctacggctcgtytgggatattgtttgactgaaggatt

SEQ ID NO: 7050 - DNA, 50 bp, Artificial Sequence
  synthetic Elaeis guineensis (oil palm) single nucleotide polymorphism (SNP) in genomic region adjacent to shatterproof1 (SHELL) shell thickness gene
gctcgtttgggatattgtttgactraaggattgaattacacagtaacttg

SEQ ID NO: 7051 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttttatcaaattttatctcttctgratagtcataatattttactagacgt

SEQ ID NO: 7052 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggatagtcataatattttactagaygttaatattgatttatgaacttatt

SEQ ID NO: 7053 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcaagagtttgtgtctactgctagytagatttgaaatctaatagatcaca

SEQ ID NO: 7054 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaaatctaatagatcacacactttraaatttgatcttgatctaatttaat

SEQ ID NO: 7055 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaggttaatttgatatgctagcayattgtgttaacctaagtttccaatt

SEQ ID NO: 7056 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcttaggtctatttttattgaactmctacctaacttggaagagttttaag

SEQ ID NO: 7057 - DNA, 50 bp, Artificial Sequence
  synthetic Elaeis guineensis (oil palm) single nucleotide polymorphism (SNP) in genomic region adjacent to shatterproof1 (SHELL) shell thickness gene
taagaagaggaagagtccttcttcyttaaagactcttatctatcgcttta

SEQ ID NO: 7058 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtgctacttaattcatcagagaaayaatttttctatgtgagggaagtgga

SEQ ID NO: 7059 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttttctatgtgagggaagtggagygtcaagagttggcaccccttgggtc

SEQ ID NO: 7060 - DNA, 50 bp, Artificial Sequence
  synthetic Elaeis guineensis (oil palm) single nucleotide polymorphism (SNP) in genomic region adjacent to shatterproof1 (SHELL) shell thickness gene
taaatggggtgcctcttatgggatragggttgagaattgataaaaattca

SEQ ID NO: 7061 - DNA, 50 bp, Artificial Sequence
  synthetic Elaeis guineensis (oil palm) single nucleotide polymorphism (SNP) in genomic region adjacent to shatterproof1 (SHELL) shell thickness gene
atgggataagggttgagaattgatraaaattcaaagatcttggcatgtga

SEQ ID NO: 7062 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgtcctaagatttgattttttcatrtgttggagtacaaaatcaaatctta

SEQ ID NO: 7063 - DNA, 50 bp, Artificial Sequence
  synthetic Elaeis guineensis (oil palm) single nucleotide polymorphism (SNP) in genomic region adjacent to shatterproof1 (SHELL) shell thickness gene
taagatttgattttttcatatgttrgagtacaaaatcaaatcttagatta

SEQ ID NO: 7064 - DNA, 50 bp, Artificial Sequence
  synthetic Elaeis guineensis (oil palm) single nucleotide polymorphism (SNP) in genomic region adjacent to shatterproof1 (SHELL) shell thickness gene
agacaatagtgcgttggtgtgatcrttctttaagaaagaagctggcagtg

SEQ ID NO: 7065 - DNA, 50 bp, Artificial Sequence
  synthetic Elaeis guineensis (oil palm) single nucleotide polymorphism (SNP) in genomic region adjacent to shatterproof1 (SHELL) shell thickness gene
agtgcgttggtgtgatcattctttragaaagaagctggcagtgttcttat

SEQ ID NO: 7066 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttgacagttttaattgttaaaattytttatttatatattaaaatttttaa

SEQ ID NO: 7067 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttaattgttaaaattttttatttayatattaaaatttttaaaattcttat

SEQ ID NO: 7068 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatttttaaaattcttattctactrcatgaccgaaatctaatagtcttga

SEQ ID NO: 7069 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctgtcctcacctttggtccctactwgtcaccttcccatcatagcctaagg

SEQ ID NO: 7070 - DNA, 50 bp, Artificial Sequence
  synthetic Elaeis guineensis (oil palm) single nucleotide polymorphism (SNP) in genomic region adjacent to shatterproof1 (SHELL) shell thickness gene
cctacttgtcaccttcccatcatascctaagggaggaagactgatggcga

SEQ ID NO: 7071 - DNA, 50 bp, Artificial Sequence
  synthetic Elaeis guineensis (oil palm) single nucleotide polymorphism (SNP) in genomic region adjacent to shatterproof1 (SHELL) shell thickness gene
tagcctaagggaggaagactgatgrcgataatcctaatccttctcctcca

SEQ ID NO: 7072 - DNA, 50 bp, Artificial Sequence
  synthetic Elaeis guineensis (oil palm) single nucleotide polymorphism (SNP) in genomic region adjacent to shatterproof1 (SHELL) shell thickness gene
cgatggtcttagcttcatctctcgrtccccattctctcacaatatcctga

SEQ ID NO: 7073 - DNA, 50 bp, Artificial Sequence
  synthetic Elaeis guineensis (oil palm) single nucleotide polymorphism (SNP) in genomic region adjacent to shatterproof1 (SHELL) shell thickness gene
cttcacggtattttagacactctcytttgctttggcttcctagctaccct

SEQ ID NO: 7074 - DNA, 50 bp, Artificial Sequence
  synthetic Elaeis guineensis (oil palm) single nucleotide polymorphism (SNP) in genomic region adjacent to shatterproof1 (SHELL) shell thickness gene
cacacttaaattgtgcaacctcgaygagtcggtggttatgtcagcactca

SEQ ID NO: 7075 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagaagtgaggccaagaagagcctyatgtgggcttgatgggagaagggct

SEQ ID NO: 7076 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggcttgatgggagaagggctctctygaccatcgaagagcctcaggtcgag

SEQ ID NO: 7077 - DNA, 50 bp, Artificial Sequence
  synthetic Elaeis guineensis (oil palm) single nucleotide polymorphism (SNP) in genomic region adjacent to shatterproof1 (SHELL) shell thickness gene
cggagatatctttactgaccctaaycgataaaaaccccatcgatcaggag

SEQ ID NO: 7078 - DNA, 50 bp, Artificial Sequence
  synthetic Elaeis guineensis (oil palm) single nucleotide polymorphism (SNP) in genomic region adjacent to shatterproof1 (SHELL) shell thickness gene
atactattgcttctactataaccayggtcataactctgaagaatgtctct

SEQ ID NO: 7079 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcctaatccatagagactatcttgraaagtatgtccgaccgtgtcaggcc

SEQ ID NO: 7080 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccgtgtcaggcccgaccgtctgagragctatctcaacatcagttcgatga

SEQ ID NO: 7081 - DNA, 50 bp, Artificial Sequence
  synthetic Elaeis guineensis (oil palm) single nucleotide polymorphism (SNP) in genomic region adjacent to shatterproof1 (SHELL) shell thickness gene
acagaagatttgctagggggtagasagatagtgtgcaggaaactttgctt

SEQ ID NO: 7082 - DNA, 50 bp, Artificial Sequence
  synthetic Elaeis guineensis (oil palm) single nucleotide polymorphism (SNP) in genomic region adjacent to shatterproof1 (SHELL) shell thickness gene
caatgaaaacatcctctactgagtytggcaccttttgattatatcaataa

SEQ ID NO: 7083 - DNA, 50 bp, Artificial Sequence
  synthetic Elaeis guineensis (oil palm) single nucleotide polymorphism (SNP) in genomic region adjacent to shatterproof1 (SHELL) shell thickness gene
atatcgcgactgcagctaagacttycataattctaaccaacgaggctctg

SEQ ID NO: 7084 - DNA, 50 bp, Artificial Sequence
  synthetic Elaeis guineensis (oil palm) single nucleotide polymorphism (SNP) in genomic region adjacent to shatterproof1 (SHELL) shell thickness gene
tggtcatgagaagaaatcctgactyaagttagaacctcaacagcaagacc

SEQ ID NO: 7085 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttcgaacatccctatagggatcagrgtaagatgatgatggtaatttggca

SEQ ID NO: 7086 - DNA, 50 bp, Artificial Sequence
  synthetic Elaeis guineensis (oil palm) single nucleotide polymorphism (SNP) in genomic region adjacent to shatterproof1 (SHELL) shell thickness gene
gatcgattggatatcgacttcaaawaagacctcatcaagatcttctcgga

SEQ ID NO: 7087 - DNA, 50 bp, Artificial Sequence
  synthetic Elaeis guineensis (oil palm) single nucleotide polymorphism (SNP) in genomic region adjacent to shatterproof1 (SHELL) shell thickness gene
gatcttctcggacatctccataggrattgggttaagacaatgatggtgac

SEQ ID NO: 7088 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatgaaccgattggatattgacttyggatgagatttcatcaggatcttcc

SEQ ID NO: 7089 - DNA, 50 bp, Artificial Sequence
  synthetic Elaeis guineensis (oil palm) single nucleotide polymorphism (SNP) in genomic region adjacent to shatterproof1 (SHELL) shell thickness gene
aggatcttcccaaacattcccatargaactgggttgagatgacaatggtg

SEQ ID NO: 7090 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttcccaaacattcccataggaactsggttgagatgacaatggtgactttg

SEQ ID NO: 7091 - DNA, 50 bp, Artificial Sequence
  synthetic Elaeis guineensis (oil palm) single nucleotide polymorphism (SNP) in genomic region adjacent to shatterproof1 (SHELL) shell thickness gene
attgcatcggatcaattagatatcracttcagacaagacctcatcaggat

SEQ ID NO: 7092 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcggatcaattagatatcgacttcrgacaagacctcatcaggatcttttc

SEQ ID NO: 7093 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgtagggatcgattaagacgatgayggtgacttggcaaaattgtcatgga

SEQ ID NO: 7094 - DNA, 50 bp, Artificial Sequence
  synthetic Elaeis guineensis (oil palm) single nucleotide polymorphism (SNP) in genomic region adjacent to shatterproof1 (SHELL) shell thickness gene
cttggcctcatcgaatgagtccagrttcactatcgacggtgttactccta

SEQ ID NO: 7095 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccggtgtgggaaataggagtcattyaacacaagcatcaaaaaggtaacaa

SEQ ID NO: 7096 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttacaaataaggctagtcgaggtcmttgtacgtgggttcggcagaatgtt

SEQ ID NO: 7097 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcctcccgggcagggcccctcacartgttcttggcagcaaggccaggagc

SEQ ID NO: 7098 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcctcgctaggacagactggtcctygagcgaggcaggctcatcttcgtct

SEQ ID NO: 7099 - DNA, 50 bp, Artificial Sequence
  synthetic Elaeis guineensis (oil palm) single nucleotide polymorphism (SNP) in genomic region adjacent to shatterproof1 (SHELL) shell thickness gene
gctaggacagactggtccttgagcraggcaggctcatcttcgtctgatga

SEQ ID NO: 7100 - DNA, 50 bp, Artificial Sequence
  synthetic Elaeis guineensis (oil palm) single nucleotide polymorphism (SNP) in genomic region adjacent to shatterproof1 (SHELL) shell thickness gene
agcgcctcttacaggcttcaaagcygtatatgtaggccattgagaatcat

SEQ ID NO: 7101 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcaacctcatccttgaactctgtcraagccttgaatttctcaaagccctt

SEQ ID NO: 7102 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcaaagcccttgagtttggcctcgrtagcaaccttcattgtctcctctta

SEQ ID NO: 7103 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttgtctcctcttagccttggacttkatgagctccacactatcttcggtag

SEQ ID NO: 7104 - DNA, 50 bp, Artificial Sequence
  synthetic Elaeis guineensis (oil palm) single nucleotide polymorphism (SNP) in genomic region adjacent to shatterproof1 (SHELL) shell thickness gene
gctctaggacctcctcaagctcagycgccttctgacgaagtaccccgatg

SEQ ID NO: 7105 - DNA, 50 bp, Artificial Sequence
  synthetic Elaeis guineensis (oil palm) single nucleotide polymorphism (SNP) in genomic region adjacent to shatterproof1 (SHELL) shell thickness gene
gatgaagacaattatgaacaacaawggacttatgccgagtagaccagtgt

SEQ ID NO: 7106 - DNA, 50 bp, Artificial Sequence
  synthetic Elaeis guineensis (oil palm) single nucleotide polymorphism (SNP) in genomic region adjacent to shatterproof1 (SHELL) shell thickness gene
atccaagggatgagcctttctctcygactaatcagtcggcagcaaaatca

SEQ ID NO: 7107 - DNA, 50 bp, Artificial Sequence
  synthetic Elaeis guineensis (oil palm) single nucleotide polymorphism (SNP) in genomic region adjacent to shatterproof1 (SHELL) shell thickness gene
taatcagtcggcagcaaaatcatcktcaccaactgtcaagcgagctggtg

SEQ ID NO: 7108 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcataccttgtttgcctcctcaaarctaggaaagatggtggctatagggt

SEQ ID NO: 7109 - DNA, 50 bp, Artificial Sequence
  synthetic Elaeis guineensis (oil palm) single nucleotide polymorphism (SNP) in genomic region adjacent to shatterproof1 (SHELL) shell thickness gene
tggccagttgatgggaatggtgacygagctaactctaaaatcatcggtgc

SEQ ID NO: 7110 - DNA, 50 bp, Artificial Sequence
  synthetic Elaeis guineensis (oil palm) single nucleotide polymorphism (SNP) in genomic region adjacent to shatterproof1 (SHELL) shell thickness gene
gggctgatctaaacacatgcaaaaraaatggttcttccattcatgaactg

SEQ ID NO: 7111 - DNA, 50 bp, Artificial Sequence
  synthetic Elaeis guineensis (oil palm) single nucleotide polymorphism (SNP) in genomic region adjacent to shatterproof1 (SHELL) shell thickness gene
caataatgttacatcctaatcaagraaaaaagtaccaccatcctctctta

SEQ ID NO: 7112 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctttgaagggagaacaccttaggayaatactgagccagttataaagaatg

SEQ ID NO: 7113 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggaaaggtgaagaccaatccgaagrgattcctcttacaatgcgactctac

SEQ ID NO: 7114 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagcctggctcgaggaggcggtgaytgagaattctgactgccatgaagat

SEQ ID NO: 7115 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaggaggcggtgactgagaattctractgccatgaagattttcacccttg

SEQ ID NO: 7116 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaggaggaggatcgattggagactrcaattggagatcaccagcatcaagg

SEQ ID NO: 7117 - DNA, 50 bp, Artificial Sequence
  synthetic Elaeis guineensis (oil palm) single nucleotide polymorphism (SNP) in genomic region adjacent to shatterproof1 (SHELL) shell thickness gene
actaacagtcaagattcaagccccrtgccattagattttgacacctgaca

SEQ ID NO: 7118 - DNA, 50 bp, Artificial Sequence
  synthetic Elaeis guineensis (oil palm) single nucleotide polymorphism (SNP) in genomic region adjacent to shatterproof1 (SHELL) shell thickness gene
agattttgacacctgacatgcattraaaataccaaatcacatgattcttc

SEQ ID NO: 7119 - DNA, 50 bp, Artificial Sequence
  synthetic Elaeis guineensis (oil palm) single nucleotide polymorphism (SNP) in genomic region adjacent to shatterproof1 (SHELL) shell thickness gene
taaaatcacttcggacttgagagtrgggaataagtattgtagaggttatc

SEQ ID NO: 7120 - DNA, 50 bp, Artificial Sequence
  synthetic Elaeis guineensis (oil palm) single nucleotide polymorphism (SNP) in genomic region adjacent to shatterproof1 (SHELL) shell thickness gene
tagaggttatccaccatccgactcracatctccttcttagattatgatca

SEQ ID NO: 7121 - DNA, 50 bp, Artificial Sequence
  synthetic Elaeis guineensis (oil palm) single nucleotide polymorphism (SNP) in genomic region adjacent to shatterproof1 (SHELL) shell thickness gene
cgacctcctaacctagtatccactkacctcgagggtaggatcctcctaat

SEQ ID NO: 7122 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctgacctcgagggtaggatcctccyaatgacgaagagcatagtctgacag

SEQ ID NO: 7123 - DNA, 50 bp, Artificial Sequence
  synthetic Elaeis guineensis (oil palm) single nucleotide polymorphism (SNP) in genomic region adjacent to shatterproof1 (SHELL) shell thickness gene
gagcatagtctgacagacctatgcragtgtcgatccgaggcaggaccttg

SEQ ID NO: 7124 - DNA, 50 bp, Artificial Sequence
  synthetic Elaeis guineensis (oil palm) single nucleotide polymorphism (SNP) in genomic region adjacent to shatterproof1 (SHELL) shell thickness gene
atccgaggcaggaccttggctcaayatgaactcagaacatcagaccattc

SEQ ID NO: 7125 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctgtgctcttattctcctattctyttttctccattattctcaggctcca

SEQ ID NO: 7126 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccattattctcaggctccaactgayttaatgttgggatttggtgcctcga

SEQ ID NO: 7127 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggatgcatggcccaggcatgggggyggcccagcacgagtgcgcaggcgca

SEQ ID NO: 7128 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcccagcacgagtgcgcaggcgcaygacccagcacagggaataggtgcgc

SEQ ID NO: 7129 - DNA, 50 bp, Artificial Sequence
  synthetic Elaeis guineensis (oil palm) single nucleotide polymorphism (SNP) in genomic region adjacent to shatterproof1 (SHELL) shell thickness gene
agtgcgcaggcgcacgacccagcayagggaataggtgcgcgcgcgtggcc

SEQ ID NO: 7130 - DNA, 50 bp, Artificial Sequence
  synthetic Elaeis guineensis (oil palm) single nucleotide polymorphism (SNP) in genomic region adjacent to shatterproof1 (SHELL) shell thickness gene
tccatggtggaccgtgggagttgtygtggtccatgcgactgtcatggact

SEQ ID NO: 7131 - DNA, 50 bp, Artificial Sequence
  synthetic Elaeis guineensis (oil palm) single nucleotide polymorphism (SNP) in genomic region adjacent to shatterproof1 (SHELL) shell thickness gene
cttcacggtcgaatggctaaggagygattcgggtgatgttttgcatgatc

SEQ ID NO: 7132 - DNA, 50 bp, Artificial Sequence
  synthetic Elaeis guineensis (oil palm) single nucleotide polymorphism (SNP) in genomic region adjacent to shatterproof1 (SHELL) shell thickness gene
cggtcatgatcaaatggacaagaayatttttaagtcctaatagaggttgt

SEQ ID NO: 7133 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttctatctgcaatgggttttggaygcttgaggggcagacgggccgaagg

SEQ ID NO: 7134 - DNA, 50 bp, Artificial Sequence
  synthetic Elaeis guineensis (oil palm) single nucleotide polymorphism (SNP) in genomic region adjacent to shatterproof1 (SHELL) shell thickness gene
agcagcgaccagagcctcaggtggrgtcgaaagagggtcttcttggtttt

SEQ ID NO: 7135 - DNA, 50 bp, Artificial Sequence
  synthetic Elaeis guineensis (oil palm) single nucleotide polymorphism (SNP) in genomic region adjacent to shatterproof1 (SHELL) shell thickness gene
tggggtcgaaagagggtcttcttgrtttttttatgagagcttttataaga

SEQ ID NO: 7136 - DNA, 50 bp, Artificial Sequence
  synthetic Elaeis guineensis (oil palm) single nucleotide polymorphism (SNP) in genomic region adjacent to shatterproof1 (SHELL) shell thickness gene
ataagagatgagaggtgagagcttyttattgaaagaaagaggtttgagag

SEQ ID NO: 7137 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtcaggctcaatcaaagtagagatyaattagtatgatgaaaaaagtaatt

SEQ ID NO: 7138 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctatagcaagcgagggtgaaggatrcgctcatccaacagggattaatcga

SEQ ID NO: 7139 - DNA, 50 bp, Artificial Sequence
  synthetic Elaeis guineensis (oil palm) single nucleotide polymorphism (SNP) in genomic region adjacent to shatterproof1 (SHELL) shell thickness gene
atgagcgagggatagagcgtgcagragcatctcagcaacttttaaaagat

SEQ ID NO: 7140 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcatctcagcaacttttaaaagatyttcactgatctccttagcattggtg

SEQ ID NO: 7141 - DNA, 50 bp, Artificial Sequence
  synthetic Elaeis guineensis (oil palm) single nucleotide polymorphism (SNP) in genomic region adjacent to shatterproof1 (SHELL) shell thickness gene
actgctcttcttgtgaaaaagagcrccattaggatggattacttctatac

SEQ ID NO: 7142 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagtagcaatatagaaggcagtgaygatgttcttctagtgtcagatgagg

SEQ ID NO: 7143 - DNA, 50 bp, Artificial Sequence
  synthetic Elaeis guineensis (oil palm) single nucleotide polymorphism (SNP) in genomic region adjacent to shatterproof1 (SHELL) shell thickness gene
actgttcacttatcggataaattgrgttgtgagatcaaggacagtgggac

SEQ ID NO: 7144 - DNA, 50 bp, Artificial Sequence
  synthetic Elaeis guineensis (oil palm) single nucleotide polymorphism (SNP) in genomic region adjacent to shatterproof1 (SHELL) shell thickness gene
taaattgagttgtgagatcaaggasagtgggacggttagcttacaagcac

SEQ ID NO: 7145 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttgtgagatcaaggacagtgggacrgttagcttacaagcacatgatggaa

SEQ ID NO: 7146 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagatccaatacgtacccagcttcwggaataatctaatttcatcgagcag

SEQ ID NO: 7147 - DNA, 50 bp, Artificial Sequence
  synthetic Elaeis guineensis (oil palm) single nucleotide polymorphism (SNP) in genomic region adjacent to shatterproof1 (SHELL) shell thickness gene
atgatggaatcctgaaggtcatgtrtggcagtaggattgtgatgaaagaa

SEQ ID NO: 7148 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaaattatggaggatactacctctwggtaaaaagcttagcatgagataga

SEQ ID NO: 7149 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttggcatctcgaattcgatccatargagaaaaatcaaagacagaggagtt

SEQ ID NO: 7150 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgcgcacaggcccgcagcagggcayggctcgcaagcttgtgcaggcccgc

SEQ ID NO: 7151 - DNA, 50 bp, Artificial Sequence
  synthetic Elaeis guineensis (oil palm) single nucleotide polymorphism (SNP) in genomic region adjacent to shatterproof1 (SHELL) shell thickness gene
caagggtgcgcgcgcatggcccagyaggattttggcacggttggaccatg

SEQ ID NO: 7152 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagggtgcgcgcgcatggcccagcrggattttggcacggttggaccatgg

SEQ ID NO: 7153 - DNA, 50 bp, Artificial Sequence
  synthetic Elaeis guineensis (oil palm) single nucleotide polymorphism (SNP) in genomic region adjacent to shatterproof1 (SHELL) shell thickness gene
tccatgcgatcgctgtggatcgacrtggtgcagggagaaaatataaaggc

SEQ ID NO: 7154 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcaggtggcttgcggtcatgatcaratggccaagaatgtttgtaagtcct

SEQ ID NO: 7155 - DNA, 50 bp, Artificial Sequence
  synthetic Elaeis guineensis (oil palm) single nucleotide polymorphism (SNP) in genomic region adjacent to shatterproof1 (SHELL) shell thickness gene
tagagagtagtcatcgatagtgagyacttgagaggcagaggagctataaa

SEQ ID NO: 7156 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggagttggtagaggatttttttggrttttttatgaacgcttttgtaaggg

SEQ ID NO: 7157 - DNA, 50 bp, Artificial Sequence
  synthetic Elaeis guineensis (oil palm) single nucleotide polymorphism (SNP) in genomic region adjacent to shatterproof1 (SHELL) shell thickness gene
aggatttttttggattttttatgarcgcttttgtaagggatgagaggtga

SEQ ID NO: 7158 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaacgcttttgtaagggatgagagrtgagagtttcttgttgaaagagata

SEQ ID NO: 7159 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttcatagtaaaattttgcatgttcygtggagataaatcttggtataatcc

SEQ ID NO: 7160 - DNA, 50 bp, Artificial Sequence
  synthetic Elaeis guineensis (oil palm) single nucleotide polymorphism (SNP) in genomic region adjacent to shatterproof1 (SHELL) shell thickness gene
gagtgcggactactatagtaggttyctcttttacacttcgagcttcagac

SEQ ID NO: 7161 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttatgatgactttgatgaagtaatygagtgatcgtggttttttctttggt

SEQ ID NO: 7162 - DNA, 50 bp, Artificial Sequence
  synthetic Elaeis guineensis (oil palm) single nucleotide polymorphism (SNP) in genomic region adjacent to shatterproof1 (SHELL) shell thickness gene
tggcccctaaagttgctcaaataargatgataatggatcagatatgaatc

SEQ ID NO: 7163 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcaagatatataaaccatccggtcyctttcagcctttttgagcatggcca

SEQ ID NO: 7164 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatttttgaatataaaatatatgcyggtgatcatcctgattggttagatt

SEQ ID NO: 7165 - DNA, 50 bp, Artificial Sequence
  synthetic Elaeis guineensis (oil palm) single nucleotide polymorphism (SNP) in genomic region adjacent to shatterproof1 (SHELL) shell thickness gene
actcttctggttagatacgaaaaaytagatcctaaattggcatgatcata

SEQ ID NO: 7166 - DNA, 50 bp, Artificial Sequence
  synthetic Elaeis guineensis (oil palm) single nucleotide polymorphism (SNP) in genomic region adjacent to shatterproof1 (SHELL) shell thickness gene
gatcctaaattggcatgatcataakccgattagagaacaaacatcacaat

SEQ ID NO: 7167 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagtaatataacattttaaatcagmttatatggcatacatgataaaaatc

SEQ ID NO: 7168 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatatattgattgggtcttagatayatataccagactaagtaactcaaat

SEQ ID NO: 7169 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttggttggttgtgctttctactaarattttacattgttataaatggtatt

SEQ ID NO: 7170 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatcttttggttgggatcctgatcrttacagtgagccatcataaaatcta

SEQ ID NO: 7171 - DNA, 50 bp, Artificial Sequence
  synthetic Elaeis guineensis (oil palm) single nucleotide polymorphism (SNP) in genomic region adjacent to shatterproof1 (SHELL) shell thickness gene
gttacagtgagccatcataaaatcyaaaaaggtctattaccaatttgcct

SEQ ID NO: 7172 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaactgtttctctttggaaagctyaggttgcatctaaaaatttttctat

SEQ ID NO: 7173 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatctacatgaataaggatcaaatmcttacttaattagcagtggaaccag

SEQ ID NO: 7174 - DNA, 50 bp, Artificial Sequence
  synthetic Elaeis guineensis (oil palm) single nucleotide polymorphism (SNP) in genomic region adjacent to shatterproof1 (SHELL) shell thickness gene
caagggagaaggggcggcaccaaargggagaggctaaggagaagaagaag

SEQ ID NO: 7175 - DNA, 50 bp, Artificial Sequence
  synthetic Elaeis guineensis (oil palm) single nucleotide polymorphism (SNP) in genomic region adjacent to shatterproof1 (SHELL) shell thickness gene
atcagtccaatactcatgaaagaargatttctatatgagataaaattgct

SEQ ID NO: 7176 - DNA, 50 bp, Artificial Sequence
  synthetic Elaeis guineensis (oil palm) single nucleotide polymorphism (SNP) in genomic region adjacent to shatterproof1 (SHELL) shell thickness gene
atactcatgaaagaaggatttctayatgagataaaattgctatcacttat

SEQ ID NO: 7177 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctatcacttatgacaaccactttgyacccactccctcacccacatgggat

SEQ ID NO: 7178 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttcagatgttggtcagcccatatragagaaaaatctcagtgcaaatagg

SEQ ID NO: 7179 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttgaatttttgaactcaattaagcytaattaatttagatctaatctgaaa

SEQ ID NO: 7180 - DNA, 50 bp, Artificial Sequence
  synthetic Elaeis guineensis (oil palm) single nucleotide polymorphism (SNP) in genomic region adjacent to shatterproof1 (SHELL) shell thickness gene
tagatctaatctgaaattaatcaayacttaaattcaatctttcatatgct

SEQ ID NO: 7181 - DNA, 50 bp, Artificial Sequence
  synthetic Elaeis guineensis (oil palm) single nucleotide polymorphism (SNP) in genomic region adjacent to shatterproof1 (SHELL) shell thickness gene
tccatggatcatagatcagaaactrttcatccccaagatcgaatctgaac

SEQ ID NO: 7182 - DNA, 50 bp, Artificial Sequence
  synthetic Elaeis guineensis (oil palm) single nucleotide polymorphism (SNP) in genomic region adjacent to shatterproof1 (SHELL) shell thickness gene
cagaaactgttcatccccaagatcraatctgaacctcatgtatagtgcta

SEQ ID NO: 7183 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaatcctatctagcaatgattttcratgtttagatagatcgaattatcgt

SEQ ID NO: 7184 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttactgcataattcgtccttttgaycctgaatgctttaggatggtctcaa

SEQ ID NO: 7185 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggatggtctcaagttaactgtcaaycaagattgtttcatccatattgtat

SEQ ID NO: 7186 - DNA, 50 bp, Artificial Sequence
  synthetic Elaeis guineensis (oil palm) single nucleotide polymorphism (SNP) in genomic region adjacent to shatterproof1 (SHELL) shell thickness gene
atggtctcaagttaactgtcaatcragattgtttcatccatattgtattt

SEQ ID NO: 7187 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttcaaatctatctcatagattgtyctgatcaagactttgctaaattaaa

SEQ ID NO: 7188 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgttcccaatagccttccatcactrtatttaaaattcagatagtccgaca

SEQ ID NO: 7189 - DNA, 50 bp, Artificial Sequence
  synthetic Elaeis guineensis (oil palm) single nucleotide polymorphism (SNP) in genomic region adjacent to shatterproof1 (SHELL) shell thickness gene
actcttgacagcagaatgctcagcrggtgagtcattagttcagtgacaat

SEQ ID NO: 7190 - DNA, 50 bp, Artificial Sequence
  synthetic Elaeis guineensis (oil palm) single nucleotide polymorphism (SNP) in genomic region adjacent to shatterproof1 (SHELL) shell thickness gene
catcatcatcctgtaatgatgtatyatttgatcacaaatatgtttaagaa

SEQ ID NO: 7191 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatgatgtatcatttgatcacaaayatgtttaagaactatacgataaatc

SEQ ID NO: 7192 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatttttattcaataattaatattyatatacaaaaaaaatttaatcgtca

SEQ ID NO: 7193 - DNA, 50 bp, Artificial Sequence
  synthetic Elaeis guineensis (oil palm) single nucleotide polymorphism (SNP) in genomic region adjacent to shatterproof1 (SHELL) shell thickness gene
tattcaataattaatattcatatayaaaaaaaatttaatcgtcatccgat

SEQ ID NO: 7194 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttaggatataattttcaacaactyccattttgactaaagctaatcagga

SEQ ID NO: 7195 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgaagtcatcgaactctttgatctygagagctttagtgaagggatcggct

SEQ ID NO: 7196 - DNA, 50 bp, Artificial Sequence
  synthetic Elaeis guineensis (oil palm) single nucleotide polymorphism (SNP) in genomic region adjacent to shatterproof1 (SHELL) shell thickness gene
agtgaagggatcggctaagttctcytttccatcgatcttctgaagtttga

SEQ ID NO: 7197 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgtgatggtgtgactttgattcttytgtctaagctatggcactgaagctg

SEQ ID NO: 7198 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctgtctaagctatggcactgaagytgtcacagtatagcagaatagagcc

SEQ ID NO: 7199 - DNA, 50 bp, Artificial Sequence
  synthetic Elaeis guineensis (oil palm) single nucleotide polymorphism (SNP) in genomic region adjacent to shatterproof1 (SHELL) shell thickness gene
gccatcaatagaagatgtaactccyagctcgtgatcaatttttgcaacca

SEQ ID NO: 7200 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttgcaaccataccatcttctttgyagcatccaatgtagcaatgtattct

SEQ ID NO: 7201 - DNA, 50 bp, Artificial Sequence
  synthetic Elaeis guineensis (oil palm) single nucleotide polymorphism (SNP) in genomic region adjacent to shatterproof1 (SHELL) shell thickness gene
tccattcatgataaatacataatcygatacgcttctactgtcatcacaat

SEQ ID NO: 7202 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcatgataaatacataatccgataygcttctactgtcatcacaatctgac

SEQ ID NO: 7203 - DNA, 50 bp, Artificial Sequence
  synthetic Elaeis guineensis (oil palm) single nucleotide polymorphism (SNP) in genomic region adjacent to shatterproof1 (SHELL) shell thickness gene
agtgtctccatagataagccattgrtctttagtatttctcaaatacttaa

SEQ ID NO: 7204 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaattgctttcacaatctttcaatrcttctcatccagatcagaatggtac

SEQ ID NO: 7205 - DNA, 50 bp, Artificial Sequence
  synthetic Elaeis guineensis (oil palm) single nucleotide polymorphism (SNP) in genomic region adjacent to shatterproof1 (SHELL) shell thickness gene
acaatctttcaatgcttctcatccrgatcagaatggtacctactcactat

SEQ ID NO: 7206 - DNA, 50 bp, Artificial Sequence
  synthetic Elaeis guineensis (oil palm) single nucleotide polymorphism (SNP) in genomic region adjacent to shatterproof1 (SHELL) shell thickness gene
agcatatggtattctactcatgcgmtctctctccttaggagttgtcggat

SEQ ID NO: 7207 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctctctccttaggagttgtcggayattcttttttggaaagagtaatttt

SEQ ID NO: 7208 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtcggatattcttttttggaaagartaattttatggtctattaaaaaata

SEQ ID NO: 7209 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaaagagtaattttatggtctattraaaaatagtcttttttaaaattatc

SEQ ID NO: 7210 - DNA, 50 bp, Artificial Sequence
  synthetic Elaeis guineensis (oil palm) single nucleotide polymorphism (SNP) in genomic region adjacent to shatterproof1 (SHELL) shell thickness gene
cacagcttcatactctgcaaagtcrggatgtcattttctagtaatagtac

SEQ ID NO: 7211 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctccgttcctaacgaagtcatacrttttggtcaccttatcaaaatgcat

SEQ ID NO: 7212 - DNA, 50 bp, Artificial Sequence
  synthetic Elaeis guineensis (oil palm) single nucleotide polymorphism (SNP) in genomic region adjacent to shatterproof1 (SHELL) shell thickness gene
agcttgcttaagtccataaatagayatttttagcttgtacacttttgact

SEQ ID NO: 7213 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcttgcttaagtccataaatagatmtttttagcttgtacacttttgactc

SEQ ID NO: 7214 - DNA, 50 bp, Artificial Sequence
  synthetic Elaeis guineensis (oil palm) single nucleotide polymorphism (SNP) in genomic region adjacent to shatterproof1 (SHELL) shell thickness gene
cctcttctttcagcttttcattaargaaagcgattttgacatccatctgc

SEQ ID NO: 7215 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttgagtattgccacaggagagaacrtcttgttatagtcaatactataatg

SEQ ID NO: 7216 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgacggtatcctttgataattagaygagctttataggtctctacctttct

SEQ ID NO: 7217 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttatttacatcctatgaattttatytcttcagatggattaactagtgtcc

SEQ ID NO: 7218 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctagtgtccatacaccattgatctytatggactccatcttagattttata

SEQ ID NO: 7219 - DNA, 50 bp, Artificial Sequence
  synthetic Elaeis guineensis (oil palm) single nucleotide polymorphism (SNP) in genomic region adjacent to shatterproof1 (SHELL) shell thickness gene
actccatcttagattttatagtctyaagctatttctgagagtcgggcctt

SEQ ID NO: 7220 - DNA, 50 bp, Artificial Sequence
  synthetic Elaeis guineensis (oil palm) single nucleotide polymorphism (SNP) in genomic region adjacent to shatterproof1 (SHELL) shell thickness gene
atcttagattttatagtctcaagcyatttctgagagtcgggcctttacat

SEQ ID NO: 7221 - DNA, 50 bp, Artificial Sequence
  synthetic Elaeis guineensis (oil palm) single nucleotide polymorphism (SNP) in genomic region adjacent to shatterproof1 (SHELL) shell thickness gene
tactctatcggatcttcttaatggyacttctactggctccaaatttgatt

SEQ ID NO: 7222 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatcaaattcaattctatatgtgtyggtccttccaccttataaacttcat

SEQ ID NO: 7223 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccaccttataaacttcatcaagttyaattttacaggcattagctccatca

SEQ ID NO: 7224 - DNA, 50 bp, Artificial Sequence
  synthetic Elaeis guineensis (oil palm) single nucleotide polymorphism (SNP) in genomic region adjacent to shatterproof1 (SHELL) shell thickness gene
atagtatcctttaattttctttggrtaccctacgaacaaacatctatcgg

SEQ ID NO: 7225 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtatcctttaattttctttgggtaycctacgaacaaacatctatcggatt

SEQ ID NO: 7226 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgacataagctagatacccccagaycctaaggtgtgagagcaccagctta

SEQ ID NO: 7227 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttgctgggcaccttattaaaaatgragcaagcagtttttagagcatatct

SEQ ID NO: 7228 - DNA, 50 bp, Artificial Sequence
  synthetic Elaeis guineensis (oil palm) single nucleotide polymorphism (SNP) in genomic region adjacent to shatterproof1 (SHELL) shell thickness gene
gagcatatctccaaaaggtgattgrcagactcataaagcccatcatagat

SEQ ID NO: 7229 - DNA, 50 bp, Artificial Sequence
  synthetic Elaeis guineensis (oil palm) single nucleotide polymorphism (SNP) in genomic region adjacent to shatterproof1 (SHELL) shell thickness gene
atagattaaactatgtctaaaaagrttcaatttttcttctccaatacgcc

SEQ ID NO: 7230 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatacgccattatattgtggtgttycaggaggggtccactgtaagagaat

SEQ ID NO: 7231 - DNA, 50 bp, Artificial Sequence
  synthetic Elaeis guineensis (oil palm) single nucleotide polymorphism (SNP) in genomic region adjacent to shatterproof1 (SHELL) shell thickness gene
cttaatactctttctagtttgtttytctacttcagcatggaatcgtttaa

SEQ ID NO: 7232 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtttctctacttcagcatggaatcktttaaacatttcaaataattttgac

SEQ ID NO: 7233 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttatacttcataagacagacaaatycatacctcgataggtcatctgtaaa

SEQ ID NO: 7234 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttatgtatatattatattttaattrtccacgtataatgacagtattattc

SEQ ID NO: 7235 - DNA, 50 bp, Artificial Sequence
  synthetic Elaeis guineensis (oil palm) single nucleotide polymorphism (SNP) in genomic region adjacent to shatterproof1 (SHELL) shell thickness gene
attataaacttgtaattaagtttgrccaaaaggcctacagagatgacatt

SEQ ID NO: 7236 - DNA, 50 bp, Artificial Sequence
  synthetic Elaeis guineensis (oil palm) single nucleotide polymorphism (SNP) in genomic region adjacent to shatterproof1 (SHELL) shell thickness gene
acatgatactactagactcgaagayaagctgcaaggtttccaaggtcaaa

SEQ ID NO: 7237 - DNA, 50 bp, Artificial Sequence
  synthetic Elaeis guineensis (oil palm) single nucleotide polymorphism (SNP) in genomic region adjacent to shatterproof1 (SHELL) shell thickness gene
gctgcaaggtttccaaggtcaaaaytggaacaagactttcatctccaacg

SEQ ID NO: 7238 - DNA, 50 bp, Artificial Sequence
  synthetic Elaeis guineensis (oil palm) single nucleotide polymorphism (SNP) in genomic region adjacent to shatterproof1 (SHELL) shell thickness gene
tccaacgttaaggaaccgctcgtcmtctcaaaactatctacttacctgta

SEQ ID NO: 7239 - DNA, 50 bp, Artificial Sequence
  synthetic Elaeis guineensis (oil palm) single nucleotide polymorphism (SNP) in genomic region adjacent to shatterproof1 (SHELL) shell thickness gene
gagaaattacaagaagttatcatayaagtatcttgtgaagcaatcgattg

SEQ ID NO: 7240 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagatgattctttttttaatgaccyagcttcttacagaagaagtactcta

SEQ ID NO: 7241 - DNA, 50 bp, Artificial Sequence
  synthetic Elaeis guineensis (oil palm) single nucleotide polymorphism (SNP) in genomic region adjacent to shatterproof1 (SHELL) shell thickness gene
agcttcttacagaagaagtactctrcttggctcttgtcaacttttgataa

SEQ ID NO: 7242 - DNA, 50 bp, Artificial Sequence
  synthetic Elaeis guineensis (oil palm) single nucleotide polymorphism (SNP) in genomic region adjacent to shatterproof1 (SHELL) shell thickness gene
tccttctcaaaagtctgcagtaacyctagcaaattatggtagttcactgc

SEQ ID NO: 7243 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagtctgcagtaactctagcaaatyatggtagttcactgcaggcttcgtc

SEQ ID NO: 7244 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggtaggattttgatagcgaattgargagatcatccttgcctaactgttca

SEQ ID NO: 7245 - DNA, 50 bp, Artificial Sequence
  synthetic Elaeis guineensis (oil palm) single nucleotide polymorphism (SNP) in genomic region adjacent to shatterproof1 (SHELL) shell thickness gene
tccttgcctaactgttcatgtaacrgaaagccaaatttactaaggcattc

SEQ ID NO: 7246 - DNA, 50 bp, Artificial Sequence
  synthetic Elaeis guineensis (oil palm) single nucleotide polymorphism (SNP) in genomic region adjacent to shatterproof1 (SHELL) shell thickness gene
cgcacacgggcattgaatactgcgyaggaggttttatatctctctgcatc

SEQ ID NO: 7247 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatgagctcttctggctttacatcytcgaacttacgattaagttcgtcgt

SEQ ID NO: 7248 - DNA, 50 bp, Artificial Sequence
  synthetic Elaeis guineensis (oil palm) single nucleotide polymorphism (SNP) in genomic region adjacent to shatterproof1 (SHELL) shell thickness gene
gctaccttcatcacacaatgcatartcatgcggttattaagccacttcat

SEQ ID NO: 7249 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttcatcacacaatgcataatcatgyggttattaagccacttcatataagt

SEQ ID NO: 7250 - DNA, 50 bp, Artificial Sequence
  synthetic Elaeis guineensis (oil palm) single nucleotide polymorphism (SNP) in genomic region adjacent to shatterproof1 (SHELL) shell thickness gene
acttcatataagtatctctcacggyacgaggagcattggctgcaagtttt

SEQ ID NO: 7251 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgcaagttttttggatgcctcatcygtaaggacatatacaatcctcttgt

SEQ ID NO: 7252 - DNA, 50 bp, Artificial Sequence
  synthetic Elaeis guineensis (oil palm) single nucleotide polymorphism (SNP) in genomic region adjacent to shatterproof1 (SHELL) shell thickness gene
taccagctgtcgaagttgggtccartaagcttgtcgctgtccaacagcgt

SEQ ID NO: 7253 - DNA, 50 bp, Artificial Sequence
  synthetic Elaeis guineensis (oil palm) single nucleotide polymorphism (SNP) in genomic region adjacent to shatterproof1 (SHELL) shell thickness gene
caaagatatggactttagtctaaaratttttttactatttttacgaattg

SEQ ID NO: 7254 - DNA, 50 bp, Artificial Sequence
  synthetic Elaeis guineensis (oil palm) single nucleotide polymorphism (SNP) in genomic region adjacent to shatterproof1 (SHELL) shell thickness gene
taggttcataatcaattattttttyaaataatttttagtaattggatttt

SEQ ID NO: 7255 - DNA, 50 bp, Artificial Sequence
  synthetic Elaeis guineensis (oil palm) single nucleotide polymorphism (SNP) in genomic region adjacent to shatterproof1 (SHELL) shell thickness gene
attttaccccaagcatcccttcagyaggcgtgtggcgccttcactgaaaa

SEQ ID NO: 7256 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaaggtacatcatgatggtcatatratgaatgataattccaatacgtaat

SEQ ID NO: 7257 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctccaatgcctatttaaaatattgractcattatcatacatcttaatagg

SEQ ID NO: 7258 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcatgactttatcactttatggacmtaataatttagaagatttgatttca

SEQ ID NO: 7259 - DNA, 50 bp, Artificial Sequence
  synthetic Elaeis guineensis (oil palm) single nucleotide polymorphism (SNP) in genomic region adjacent to shatterproof1 (SHELL) shell thickness gene
gataacctgcaaactgcaaattctyccactgacttcattaagtcatgcaa

SEQ ID NO: 7260 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttctcccactgacttcattaagtcrtgcaaaggattagacacaagttggt

SEQ ID NO: 7261 - DNA, 50 bp, Artificial Sequence
  synthetic Elaeis guineensis (oil palm) single nucleotide polymorphism (SNP) in genomic region adjacent to shatterproof1 (SHELL) shell thickness gene
caaaatataatctactatgttggtmagataaatgagatcagtgggaggga

SEQ ID NO: 7262 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttaactcaccgtagatgcatctagrtgaatagctcccaattaaaaatcac

SEQ ID NO: 7263 - DNA, 50 bp, Artificial Sequence
  synthetic Elaeis guineensis (oil palm) single nucleotide polymorphism (SNP) in genomic region adjacent to shatterproof1 (SHELL) shell thickness gene
attcaaagcttaattcataattaaktgtatgaaatatgtgtttcagtctg

SEQ ID NO: 7264 - DNA, 50 bp, Artificial Sequence
  synthetic Elaeis guineensis (oil palm) single nucleotide polymorphism (SNP) in genomic region adjacent to shatterproof1 (SHELL) shell thickness gene
aataaatttttataatatgtttaayaattaaacatacataggtatgatct

SEQ ID NO: 7265 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggtatgatctaaacttcatacatayatctcatgcatcatgataactttta

SEQ ID NO: 7266 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctaaacttcatacatacatctcatrcatcatgataacttttagattaata

SEQ ID NO: 7267 - DNA, 50 bp, Artificial Sequence
  synthetic Elaeis guineensis (oil palm) single nucleotide polymorphism (SNP) in genomic region adjacent to shatterproof1 (SHELL) shell thickness gene
atcatgataacttttagattaataycgattacatcttatgtaatatgcaa

SEQ ID NO: 7268 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaattttatcctattataataaatyataaattattttagatctaatctaa

SEQ ID NO: 7269 - DNA, 50 bp, Artificial Sequence
  synthetic Elaeis guineensis (oil palm) single nucleotide polymorphism (SNP) in genomic region adjacent to shatterproof1 (SHELL) shell thickness gene
atcctattataataaattataaatyattttagatctaatctaaatatatt

SEQ ID NO: 7270 - DNA, 50 bp, Artificial Sequence
  synthetic Elaeis guineensis (oil palm) single nucleotide polymorphism (SNP) in genomic region adjacent to shatterproof1 (SHELL) shell thickness gene
taattttatatataattacatcaayatataattattgataaaataatttt

SEQ ID NO: 7271 - DNA, 50 bp, Artificial Sequence
  synthetic Elaeis guineensis (oil palm) single nucleotide polymorphism (SNP) in genomic region adjacent to shatterproof1 (SHELL) shell thickness gene
atttttaataaaatctattttcgtrcagtgctgaatttcaatagaattta

SEQ ID NO: 7272 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctattttcgtacagtgctgaattycaatagaatttagatctaaatatct

SEQ ID NO: 7273 - DNA, 50 bp, Artificial Sequence
  synthetic Elaeis guineensis (oil palm) single nucleotide polymorphism (SNP) in genomic region adjacent to shatterproof1 (SHELL) shell thickness gene
catctaatccaatcaaagttagatmaaaaaaaatttatacaaatagattc

SEQ ID NO: 7274 - DNA, 50 bp, Artificial Sequence
  synthetic Elaeis guineensis (oil palm) single nucleotide polymorphism (SNP) in genomic region adjacent to shatterproof1 (SHELL) shell thickness gene
gatttaatatctcataaaaaatctyagttacatcttatgtaattaatctc

SEQ ID NO: 7275 - DNA, 50 bp, Artificial Sequence
  synthetic Elaeis guineensis (oil palm) single nucleotide polymorphism (SNP) in genomic region adjacent to shatterproof1 (SHELL) shell thickness gene
gacctgctctgataccaattaaagrgaaggaaaactatttctcttcagaa

SEQ ID NO: 7276 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctctgataccaattaaagggaaggraaactatttctcttcagaaggccca

SEQ ID NO: 7277 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttattaatctatataaataaagatyaaatttttacctaattagtaataaa

SEQ ID NO: 7278 - DNA, 50 bp, Artificial Sequence
  synthetic Elaeis guineensis (oil palm) single nucleotide polymorphism (SNP) in genomic region adjacent to shatterproof1 (SHELL) shell thickness gene
taatcaaatgaaggaggagatataytggtgtgacacctcacactagcagg

SEQ ID NO: 7279 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtggaatgcccaaggagggcccacrcccaaggaagaaggggcggcaccaa

SEQ ID NO: 7280 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatttataaataaattttatgaccyaataagtataggagttctaacttaa

SEQ ID NO: 7281 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaatcagtccatgaaataagaattsctacatgagatagaattgtcatcac

SEQ ID NO: 7282 - DNA, 50 bp, Artificial Sequence
  synthetic Elaeis guineensis (oil palm) single nucleotide polymorphism (SNP) in genomic region adjacent to shatterproof1 (SHELL) shell thickness gene
accagcaccattttaggtgttggtyggtccatatgagaggagaatctcaa

SEQ ID NO: 7283 - DNA, 50 bp, Artificial Sequence
  synthetic Elaeis guineensis (oil palm) single nucleotide polymorphism (SNP) in genomic region adjacent to shatterproof1 (SHELL) shell thickness gene
gagaggagaatctcaatgcaaataraatttttcatatctcatcccaaatg

SEQ ID NO: 7284 - DNA, 50 bp, Artificial Sequence
  synthetic Elaeis guineensis (oil palm) single nucleotide polymorphism (SNP) in genomic region adjacent to shatterproof1 (SHELL) shell thickness gene
atcccaaatggatccgatttgaatycaattcgaagcaggttcgaaataat

SEQ ID NO: 7285 - DNA, 50 bp, Artificial Sequence
  synthetic Elaeis guineensis (oil palm) single nucleotide polymorphism (SNP) in genomic region adjacent to shatterproof1 (SHELL) shell thickness gene
tccgatttgaatccaattcgaagcrggttcgaaataattttgaaaggcta

SEQ ID NO: 7286 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcaggttcgaaataattttgaaagrctattaatcacaaactctttagaac

SEQ ID NO: 7287 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagtctaacttaaatttttagattyaattaaatataattaatttagatct

SEQ ID NO: 7288 - DNA, 50 bp, Artificial Sequence
  synthetic Elaeis guineensis (oil palm) single nucleotide polymorphism (SNP) in genomic region adjacent to shatterproof1 (SHELL) shell thickness gene
caactcttcaattctatttgacccmtaatttaatttttcaatcaagttag

SEQ ID NO: 7289 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatttgacccataatttaatttttyaatcaagttagcttatatgcttaat

SEQ ID NO: 7290 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttctattttgtctgacttatgtgygtgactccataggttccaacactaa

SEQ ID NO: 7291 - DNA, 50 bp, Artificial Sequence
  synthetic Elaeis guineensis (oil palm) single nucleotide polymorphism (SNP) in genomic region adjacent to shatterproof1 (SHELL) shell thickness gene
agtcggtaacataagaatcaatttytgtactaatcgagataccatctagc

SEQ ID NO: 7292 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctaatcgagataccatctagcaatratttttgatatccagatagatcaaa

SEQ ID NO: 7293 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgcttcacgagcagctcttgacagyaaaatactcagtagatgagtcacat

SEQ ID NO: 7294 - DNA, 50 bp, Artificial Sequence
  synthetic Elaeis guineensis (oil palm) single nucleotide polymorphism (SNP) in genomic region adjacent to shatterproof1 (SHELL) shell thickness gene
atctcatctgtatgccatatcagtrtcaccacactctttggttaagaaga

SEQ ID NO: 7295 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctctttggttaagaagacaaccaayctatatggcacacaacgacctctac

SEQ ID NO: 7296 - DNA, 50 bp, Artificial Sequence
  synthetic Elaeis guineensis (oil palm) single nucleotide polymorphism (SNP) in genomic region adjacent to shatterproof1 (SHELL) shell thickness gene
tacgataaatcttttttttatcatrcactaacatagttttaaggacttta

SEQ ID NO: 7297 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttttatcatgcactaacatagttytaaggactttattatagcacaagag

SEQ ID NO: 7298 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttgtaatgaaaaatatcagaatawtttttattcaataatcaataattta

SEQ ID NO: 7299 - DNA, 50 bp, Artificial Sequence
  synthetic Elaeis guineensis (oil palm) single nucleotide polymorphism (SNP) in genomic region adjacent to shatterproof1 (SHELL) shell thickness gene
taatcaataatttatatacaaagaraaattcaatcatcacacgattaatt

SEQ ID NO: 7300 - DNA, 50 bp, Artificial Sequence
  synthetic Elaeis guineensis (oil palm) single nucleotide polymorphism (SNP) in genomic region adjacent to shatterproof1 (SHELL) shell thickness gene
aacataatttccaacagactcttcratgcttaaatcaattagagttttag

SEQ ID NO: 7301 - DNA, 50 bp, Artificial Sequence
  synthetic Elaeis guineensis (oil palm) single nucleotide polymorphism (SNP) in genomic region adjacent to shatterproof1 (SHELL) shell thickness gene
gactgtaatctgacaaggggatgtyggatcggatggataacccctataac

SEQ ID NO: 7302 - DNA, 50 bp, Artificial Sequence
  synthetic Elaeis guineensis (oil palm) single nucleotide polymorphism (SNP) in genomic region adjacent to shatterproof1 (SHELL) shell thickness gene
atcactatactagacttcaatcaaygacccaaccttctctctagaagttt

SEQ ID NO: 7303 - DNA, 50 bp, Artificial Sequence
  synthetic Elaeis guineensis (oil palm) single nucleotide polymorphism (SNP) in genomic region adjacent to shatterproof1 (SHELL) shell thickness gene
atactagacttcaatcaatgacccraccttctctctagaagtttaattgc

SEQ ID NO: 7304 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctcttggggcatcattaatatgctkcttcataaatcttgtcacatttatg

SEQ ID NO: 7305 - DNA, 50 bp, Artificial Sequence
  synthetic Elaeis guineensis (oil palm) single nucleotide polymorphism (SNP) in genomic region adjacent to shatterproof1 (SHELL) shell thickness gene
atcttgtcacatttatgagggctgratggcttgaagtatggtgccacaat

SEQ ID NO: 7306 - DNA, 50 bp, Artificial Sequence
  synthetic Elaeis guineensis (oil palm) single nucleotide polymorphism (SNP) in genomic region adjacent to shatterproof1 (SHELL) shell thickness gene
cttttagatcccatgtcgcaccccrtcgattaccctatgtggcttaattt

SEQ ID NO: 7307 - DNA, 50 bp, Artificial Sequence
  synthetic Elaeis guineensis (oil palm) single nucleotide polymorphism (SNP) in genomic region adjacent to shatterproof1 (SHELL) shell thickness gene
catcacagttgatcgaaggagggcyttttgtcattaccatcttcctcagc

SEQ ID NO: 7308 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctctttctctttctcgtctcttcartttttttttgcgtccagtagcttct

SEQ ID NO: 7309 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttgcgtccagtagcttcttcctctrtatgtcttctgatagtagtgaggct

SEQ ID NO: 7310 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcgatcccttagaccatgatgtacragtagccccatatgcaggtttagag

SEQ ID NO: 7311 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcatcttctcgatgaaggaaaaatygcctttttcctgtgtaggatctttc

SEQ ID NO: 7312 - DNA, 50 bp, Artificial Sequence
  synthetic Elaeis guineensis (oil palm) single nucleotide polymorphism (SNP) in genomic region adjacent to shatterproof1 (SHELL) shell thickness gene
taaattttaaatttttatcctatgytattttagatctaatgtctattaga

SEQ ID NO: 7313 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttaaatttttatcctatgctatttyagatctaatgtctattagatctaat

SEQ ID NO: 7314 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaatttttatcctatgctattttaratctaatgtctattagatctaattt

SEQ ID NO: 7315 - DNA, 50 bp, Artificial Sequence
  synthetic Elaeis guineensis (oil palm) single nucleotide polymorphism (SNP) in genomic region adjacent to shatterproof1 (SHELL) shell thickness gene
atcctatgctattttagatctaatrtctattagatctaattttattatct

SEQ ID NO: 7316 - DNA, 50 bp, Artificial Sequence
  synthetic Elaeis guineensis (oil palm) single nucleotide polymorphism (SNP) in genomic region adjacent to shatterproof1 (SHELL) shell thickness gene
catacctcaagggtaatctaattaycctgtagatgatcgcagtactgctt

SEQ ID NO: 7317 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctgcttgaggttctgatgtagccaygcaagcacctggcctctaccagtat

SEQ ID NO: 7318 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgcttgaggttctgatgtagccacrcaagcacctggcctctaccagtatc

SEQ ID NO: 7319 - DNA, 50 bp, Artificial Sequence
  synthetic Elaeis guineensis (oil palm) single nucleotide polymorphism (SNP) in genomic region adjacent to shatterproof1 (SHELL) shell thickness gene
aggttctgatgtagccacgcaagcrcctggcctctaccagtatccactca

SEQ ID NO: 7320 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatccactcaggtaggatctggaayatcttcttctcatgattctatgctc

SEQ ID NO: 7321 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgatagaagaataacccttttattyatttatagtcaaaattataattttg

SEQ ID NO: 7322 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttatagtcaaaattataattttgtycttagatttgtacagaaatgtgtca

SEQ ID NO: 7323 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctttgatttctactctatcccttcwtctataatatttttgacttctataa

SEQ ID NO: 7324 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtttagcttggtctagggcaatccycacttgtctcctaataaagataaat

SEQ ID NO: 7325 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcctcacttgtctcctaataaagayaaatttttatccttcttgaggatga

SEQ ID NO: 7326 - DNA, 50 bp, Artificial Sequence
  synthetic Elaeis guineensis (oil palm) single nucleotide polymorphism (SNP) in genomic region adjacent to shatterproof1 (SHELL) shell thickness gene
gagccactggtggttgagccattgmggtccgttgtgccgatgacttcaga

SEQ ID NO: 7327 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggagttggtgaagatgactttgctrttggttgattgatcagagaggaggg

SEQ ID NO: 7328 - DNA, 50 bp, Artificial Sequence
  synthetic Elaeis guineensis (oil palm) single nucleotide polymorphism (SNP) in genomic region adjacent to shatterproof1 (SHELL) shell thickness gene
agattattggtgcttcttgtgccawcctcctcagggtgagtatttcatct

SEQ ID NO: 7329 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgagggtttggttggtttcaactgrgcaaaacttttgctagagataaaat

SEQ ID NO: 7330 - DNA, 50 bp, Artificial Sequence
  synthetic Elaeis guineensis (oil palm) single nucleotide polymorphism (SNP) in genomic region adjacent to shatterproof1 (SHELL) shell thickness gene
agaggagaaggtgaaggtcatcacygaggccaaattcaagggcatcgaaa

SEQ ID NO: 7331 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgagggcttcatggtggcctatctrtacgatttcaaagcctataagttgc

SEQ ID NO: 7332 - DNA, 50 bp, Artificial Sequence
  synthetic Elaeis guineensis (oil palm) single nucleotide polymorphism (SNP) in genomic region adjacent to shatterproof1 (SHELL) shell thickness gene
attgagaatgccatggggggcactycaaaggagaccgtcaatcatactat

SEQ ID NO: 7333 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttctaatgaaatgaatttcctcttrttatcttttgatgcttgtattgagt

SEQ ID NO: 7334 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagtcgatgagaagttgatccatgrtaatttttgccaaatctccatcatc

SEQ ID NO: 7335 - DNA, 50 bp, Artificial Sequence
  synthetic Elaeis guineensis (oil palm) single nucleotide polymorphism (SNP) in genomic region adjacent to shatterproof1 (SHELL) shell thickness gene
taatgtttgccaaattgccatcatyatcttaacccgatccttagagggat

SEQ ID NO: 7336 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaaagatcctaatgaagtcgcagycgaaactgatgccaagtcgatctgt

SEQ ID NO: 7337 - DNA, 50 bp, Artificial Sequence
  synthetic Elaeis guineensis (oil palm) single nucleotide polymorphism (SNP) in genomic region adjacent to shatterproof1 (SHELL) shell thickness gene
cattattgtcttaacccaatcccargagagacttttgggaagatcctaac

SEQ ID NO: 7338 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctatcatcgtcttaatctaattctwtgagggatgttcaaaaagatcccaa

SEQ ID NO: 7339 - DNA, 50 bp, Artificial Sequence
  synthetic Elaeis guineensis (oil palm) single nucleotide polymorphism (SNP) in genomic region adjacent to shatterproof1 (SHELL) shell thickness gene
agtcaattcaaagtcaatcagtggyaatttttgtcagtcgtcattgtcgt

SEQ ID NO: 7340 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggtaatttttatcaaatcaccatcmtcatcttaatccgatctctagagag

SEQ ID NO: 7341 - DNA, 50 bp, Artificial Sequence
  synthetic Elaeis guineensis (oil palm) single nucleotide polymorphism (SNP) in genomic region adjacent to shatterproof1 (SHELL) shell thickness gene
gatcaccattataaaggtcttagtygtagccaaaatatcttcatgaggtc

SEQ ID NO: 7342 - DNA, 50 bp, Artificial Sequence
  synthetic Elaeis guineensis (oil palm) single nucleotide polymorphism (SNP) in genomic region adjacent to shatterproof1 (SHELL) shell thickness gene
acatgaggagcccgaaaatacagtytgaaggcctaggcatgcagcctgca

SEQ ID NO: 7343 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccgaaaatacagtctgaaggcctargcatgcagcctgcagcatgcacggc

SEQ ID NO: 7344 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaatcatagtgcataggaggattkgtgcgatccagcggtcaggaaggca

SEQ ID NO: 7345 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcataggaggatttgtgcgatccarcggtcaggaaggcatgcgatcgtga

SEQ ID NO: 7346 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcatgatcgaaagttgtattatgtratcggatggccaaaagcgcttgtgg

SEQ ID NO: 7347 - DNA, 50 bp, Artificial Sequence
  synthetic Elaeis guineensis (oil palm) single nucleotide polymorphism (SNP) in genomic region adjacent to shatterproof1 (SHELL) shell thickness gene
attatgtaatcggatggccaaaagygcttgtggcaaagatcgaatggtca

SEQ ID NO: 7348 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaagagtttggagaggctgtggagyagaggtgaagcagcttgatgtcagt

SEQ ID NO: 7349 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcattaggagcagcttgtgtgtagytgcaaaagtagtcgagagtgtccta

SEQ ID NO: 7350 - DNA, 50 bp, Artificial Sequence
  synthetic Elaeis guineensis (oil palm) single nucleotide polymorphism (SNP) in genomic region adjacent to shatterproof1 (SHELL) shell thickness gene
agtagtcgagagtgtcctagaacgrtcatgggagtgaccgtcagtatagg

SEQ ID NO: 7351 - DNA, 50 bp, Artificial Sequence
  synthetic Elaeis guineensis (oil palm) single nucleotide polymorphism (SNP) in genomic region adjacent to shatterproof1 (SHELL) shell thickness gene
agggtctccttgtgggattttataygagcttttatgagtgttgtgcatgt

SEQ ID NO: 7352 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctttctactgcaacaagtggtacyagatctccaataattggtatcagag

SEQ ID NO: 7353 - DNA, 50 bp, Artificial Sequence
  synthetic Elaeis guineensis (oil palm) single nucleotide polymorphism (SNP) in genomic region adjacent to shatterproof1 (SHELL) shell thickness gene
agcgtcagcttgttcgaactgtggyggtattgatcaagattgaagaagat

SEQ ID NO: 7354 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtattgatcaagattgaagaagatrgagaagtcaggtataatcatggtgg

SEQ ID NO: 7355 - DNA, 50 bp, Artificial Sequence
  synthetic Elaeis guineensis (oil palm) single nucleotide polymorphism (SNP) in genomic region adjacent to shatterproof1 (SHELL) shell thickness gene
tactctcttgtgtaaagagaagccrtctaccaaagaagatgtcagtggga

SEQ ID NO: 7356 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtgtaaagagaagccgtctaccaargaagatgtcagtgggagcccagtat

SEQ ID NO: 7357 - DNA, 50 bp, Artificial Sequence
  synthetic Elaeis guineensis (oil palm) single nucleotide polymorphism (SNP) in genomic region adjacent to shatterproof1 (SHELL) shell thickness gene
agaagccgtctaccaaagaagatgycagtgggagcccagtatgaggtgga

SEQ ID NO: 7358 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcgaccccatgtttgtccatctatraatagctggcgtatgactcaggatg

SEQ ID NO: 7359 - DNA, 50 bp, Artificial Sequence
  synthetic Elaeis guineensis (oil palm) single nucleotide polymorphism (SNP) in genomic region adjacent to shatterproof1 (SHELL) shell thickness gene
catgtttgtccatctatgaatagcwggcgtatgactcaggatgtgggggc

SEQ ID NO: 7360 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatgaatagctggcgtatgactcargatgtgggggcaagaagatccaaaa

SEQ ID NO: 7361 - DNA, 50 bp, Artificial Sequence
  synthetic Elaeis guineensis (oil palm) single nucleotide polymorphism (SNP) in genomic region adjacent to shatterproof1 (SHELL) shell thickness gene
agatagagatagttgagatttggtrccttgaattcgatctacaacagaag

SEQ ID NO: 7362 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctacaacagaagagaagcccagatktggagaaattcatatgcgaggagcc

SEQ ID NO: 7363 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaagcccagatttggagaaattcakatgcgaggagcctaaaaatgcagtt

SEQ ID NO: 7364 - DNA, 50 bp, Artificial Sequence
  synthetic Elaeis guineensis (oil palm) single nucleotide polymorphism (SNP) in genomic region adjacent to shatterproof1 (SHELL) shell thickness gene
cctaggtgcgtagtgtgtgacgtgmgtggcccagcggggcctgctgcact

SEQ ID NO: 7365 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggtggaccgttggaggaagtcacgrtccacacatgttctatggaccatca

SEQ ID NO: 7366 - DNA, 50 bp, Artificial Sequence
  synthetic Elaeis guineensis (oil palm) single nucleotide polymorphism (SNP) in genomic region adjacent to shatterproof1 (SHELL) shell thickness gene
accaagaaggcatgcggtcataatygaatggcgatcgagtgtgatcgggg

SEQ ID NO: 7367 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcatgcggtcataatcgaatggcgrtcgagtgtgatcgggggctgtattg

SEQ ID NO: 7368 - DNA, 50 bp, Artificial Sequence
  synthetic Elaeis guineensis (oil palm) single nucleotide polymorphism (SNP) in genomic region adjacent to shatterproof1 (SHELL) shell thickness gene
agtgtgatcgggggctgtattgcaygatcgatggccagaagcgcttgcgg

SEQ ID NO: 7369 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgatcgggggctgtattgcatgatygatggccagaagcgcttgcggaaaa

SEQ ID NO: 7370 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctagattggtttggaccctataamagagttcaaagaggttgtggagcag

SEQ ID NO: 7371 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcagccgagagtatcctggaatagycgtgggagtgatcatgagtgtaagg

SEQ ID NO: 7372 - DNA, 50 bp, Artificial Sequence
  synthetic Elaeis guineensis (oil palm) single nucleotide polymorphism (SNP) in genomic region adjacent to shatterproof1 (SHELL) shell thickness gene
gccgagagtatcctggaatagccgygggagtgatcatgagtgtaaggacg

SEQ ID NO: 7373 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgggagtgatcatgagtgtaaggaygaggctgagacatgatgtagtggct

SEQ ID NO: 7374 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtgagtgctctccttttgtacttgytattttctctcatagtaaagcttag

SEQ ID NO: 7375 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatttcatctcttctttttttctgytgcaacaaatggtaccagatctcca

SEQ ID NO: 7376 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcgatctcatccttgagctagaggyatttctcgatgtcgtaattaggctc

SEQ ID NO: 7377 - DNA, 50 bp, Artificial Sequence
  synthetic Elaeis guineensis (oil palm) single nucleotide polymorphism (SNP) in genomic region adjacent to shatterproof1 (SHELL) shell thickness gene
tattcagcctacttccctgtggccygagcctcttttgtctatgcatattt

SEQ ID NO: 7378 - DNA, 50 bp, Artificial Sequence
  synthetic Elaeis guineensis (oil palm) single nucleotide polymorphism (SNP) in genomic region adjacent to shatterproof1 (SHELL) shell thickness gene
gagaggatcatcgacaaaaggcatyggagttatatgctcttattctagcc

SEQ ID NO: 7379 - DNA, 50 bp, Artificial Sequence
  synthetic Elaeis guineensis (oil palm) single nucleotide polymorphism (SNP) in genomic region adjacent to shatterproof1 (SHELL) shell thickness gene
gccattctcttcttcctcattaatygagttaatcacccttcctctggtat

SEQ ID NO: 7380 - DNA, 50 bp, Artificial Sequence
  synthetic Elaeis guineensis (oil palm) single nucleotide polymorphism (SNP) in genomic region adjacent to shatterproof1 (SHELL) shell thickness gene
aattgagttaatcacccttcctctrgtatccatctattgctgcaagattc

SEQ ID NO: 7381 - DNA, 50 bp, Artificial Sequence
  synthetic Elaeis guineensis (oil palm) single nucleotide polymorphism (SNP) in genomic region adjacent to shatterproof1 (SHELL) shell thickness gene
attgatgtggctgaggatggatatsatttggggaccgagatgccaaagaa

SEQ ID NO: 7382 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttattacctctttatataaaggtraaaatttatgttgtcatgctggaac

SEQ ID NO: 7383 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgctggaacttagtaggctatttgrtcctaattttctaggctgctaggtc

SEQ ID NO: 7384 - DNA, 50 bp, Artificial Sequence
  synthetic Elaeis guineensis (oil palm) single nucleotide polymorphism (SNP) in genomic region adjacent to shatterproof1 (SHELL) shell thickness gene
aggctatttgatcctaattttctargctgctaggtctcaatctgatatac

SEQ ID NO: 7385 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggaggttggatagaaaccgatgacrtaaagctgctttgccttggtttctc

SEQ ID NO: 7386 - DNA, 50 bp, Artificial Sequence
  synthetic Elaeis guineensis (oil palm) single nucleotide polymorphism (SNP) in genomic region adjacent to shatterproof1 (SHELL) shell thickness gene
caattgaaagtttagtgaaataggrcttggacaataaaggcctttacggt

SEQ ID NO: 7387 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggggggagttggggtctgaaatggraatgacaatggataactctcattct

SEQ ID NO: 7388 - DNA, 50 bp, Artificial Sequence
  synthetic Elaeis guineensis (oil palm) single nucleotide polymorphism (SNP) in genomic region adjacent to shatterproof1 (SHELL) shell thickness gene
attctgaagtggaatgaaaatgatygaatccccctaaaacccaatcctca

SEQ ID NO: 7389 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatttcaatttcgattctagtttcratttcgattgtaaattaaacaccct

SEQ ID NO: 7390 - DNA, 50 bp, Artificial Sequence
  synthetic Elaeis guineensis (oil palm) single nucleotide polymorphism (SNP) in genomic region adjacent to shatterproof1 (SHELL) shell thickness gene
actgcttttgtcactaaagtcttakgttagcatatgttaacttgttttgg

SEQ ID NO: 7391 - DNA, 50 bp, Artificial Sequence
  synthetic Elaeis guineensis (oil palm) single nucleotide polymorphism (SNP) in genomic region adjacent to shatterproof1 (SHELL) shell thickness gene
actgggcaacatggatggccaagcrtttacatgcctataaacaaatcaag

SEQ ID NO: 7392 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgggcaacatggatggccaagcgtytacatgcctataaacaaatcaagat

SEQ ID NO: 7393 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttagaactactttgatcgataaagraagatttatcgtgtagtccttaaat

SEQ ID NO: 7394 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgatcgataaagaaagatttatcgygtagtccttaaattggtttatgacc

SEQ ID NO: 7395 - DNA, 50 bp, Artificial Sequence
  synthetic Elaeis guineensis (oil palm) single nucleotide polymorphism (SNP) in genomic region adjacent to shatterproof1 (SHELL) shell thickness gene
tataggtcgttgtgtgccatatacrttggttgtcctcgtaaccaaatggt

SEQ ID NO: 7396 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaatggtgtggagatactggtatgrcatgcgggtgagatatagaagtaca

SEQ ID NO: 7397 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctaactgagtttctaattcagtgaygaaagatttttagttacaatcaagt

SEQ ID NO: 7398 - DNA, 50 bp, Artificial Sequence
  synthetic Elaeis guineensis (oil palm) single nucleotide polymorphism (SNP) in genomic region adjacent to shatterproof1 (SHELL) shell thickness gene
cgaaagatttttagttacaatcaartacttatgaagttggtgtataagtc

SEQ ID NO: 7399 - DNA, 50 bp, Artificial Sequence
  synthetic Elaeis guineensis (oil palm) single nucleotide polymorphism (SNP) in genomic region adjacent to shatterproof1 (SHELL) shell thickness gene
caagtacttatgaagttggtgtatragtcaagatgggattgatcccttcg

SEQ ID NO: 7400 - DNA, 50 bp, Artificial Sequence
  synthetic Elaeis guineensis (oil palm) single nucleotide polymorphism (SNP) in genomic region adjacent to shatterproof1 (SHELL) shell thickness gene
catgtgatggatttaaaaaaaattraaatacaatgtggatgacttatcta

SEQ ID NO: 7401 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcgatctatccggatgttgggtcaycattgctagatgattacatcgattg

SEQ ID NO: 7402 - DNA, 50 bp, Artificial Sequence
  synthetic Elaeis guineensis (oil palm) single nucleotide polymorphism (SNP) in genomic region adjacent to shatterproof1 (SHELL) shell thickness gene
atcatgcggctgatcaacgattgaraatcgttcaagggcttaatcatcaa

SEQ ID NO: 7403 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagggcttaatcatcaattcgattratggttaaccttatgcaaaaattat

SEQ ID NO: 7404 - DNA, 50 bp, Artificial Sequence
  synthetic Elaeis guineensis (oil palm) single nucleotide polymorphism (SNP) in genomic region adjacent to shatterproof1 (SHELL) shell thickness gene
attaaattattgattagcttagttygattgagcaaagaggatcaaataaa

SEQ ID NO: 7405 - DNA, 50 bp, Artificial Sequence
  synthetic Elaeis guineensis (oil palm) single nucleotide polymorphism (SNP) in genomic region adjacent to shatterproof1 (SHELL) shell thickness gene
attattgattagcttagtttgattragcaaagaggatcaaataaaatcta

SEQ ID NO: 7406 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttagtttgattgagcaaagaggatyaaataaaatctaattgagttggatt

SEQ ID NO: 7407 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaggagaattatccctgatttatyaggattttgattcaatcaatttcta

SEQ ID NO: 7408 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcatatattttatttgggctaaaayagacatgatttggtttggattcaaa

SEQ ID NO: 7409 - DNA, 50 bp, Artificial Sequence
  synthetic Elaeis guineensis (oil palm) single nucleotide polymorphism (SNP) in genomic region adjacent to shatterproof1 (SHELL) shell thickness gene
atattttatttgggctaaaacagayatgatttggtttggattcaaataag

SEQ ID NO: 7410 - DNA, 50 bp, Artificial Sequence
  synthetic Elaeis guineensis (oil palm) single nucleotide polymorphism (SNP) in genomic region adjacent to shatterproof1 (SHELL) shell thickness gene
tggattcaaataaggaaattaagartccttattggaatagaactcttctt

SEQ ID NO: 7411 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtttttgtataaaatttttttatgycaaagagtgctttcccttctctatc

SEQ ID NO: 7412 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctcacatctaaatttgaataggatyagattttaaatggtgtgttcaaatc

SEQ ID NO: 7413 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtgctacattttaaggatatttttyatgaaaaattatttggagaactatt

SEQ ID NO: 7414 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtgcataaaaattaggtttctaggrttttggtccttagggtttgagaaga

SEQ ID NO: 7415 - DNA, 50 bp, Artificial Sequence
  synthetic Elaeis guineensis (oil palm) single nucleotide polymorphism (SNP) in genomic region adjacent to shatterproof1 (SHELL) shell thickness gene
gctagcactttcgagaagatcgatyagatcgaggcttcaagtagattttt

SEQ ID NO: 7416 - DNA, 50 bp, Artificial Sequence
  synthetic Elaeis guineensis (oil palm) single nucleotide polymorphism (SNP) in genomic region adjacent to shatterproof1 (SHELL) shell thickness gene
cctacctatcagcaaaacttgggartgtggcggaggctcggccgcccggg

SEQ ID NO: 7417 - DNA, 50 bp, Artificial Sequence
  synthetic Elaeis guineensis (oil palm) single nucleotide polymorphism (SNP) in genomic region adjacent to shatterproof1 (SHELL) shell thickness gene
acttgggaatgtggcggaggctcgrccgcccgggaggtttgaagagatgt

SEQ ID NO: 7418 - DNA, 50 bp, Artificial Sequence
  synthetic Elaeis guineensis (oil palm) single nucleotide polymorphism (SNP) in genomic region adjacent to shatterproof1 (SHELL) shell thickness gene
cccgggaggtttgaagagatgttgycggaggtcgaaagtcagttggatcc

SEQ ID NO: 7419 - DNA, 50 bp, Artificial Sequence; identical to SEQ ID NO: 7418
  synthetic Elaeis guineensis (oil palm) single nucleotide polymorphism (SNP) in genomic region adjacent to shatterproof1 (SHELL) shell thickness gene

SEQ ID NO: 7420 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctatagctaaaactatcaacgaaamgatataattttgtaactttctttac

SEQ ID NO: 7421 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcttcggttgtaaacaaagcaactwtatcttgaagtgtagttttctaact

SEQ ID NO: 7422 - DNA, 50 bp, Artificial Sequence
  synthetic Elaeis guineensis (oil palm) single nucleotide polymorphism (SNP) in genomic region adjacent to shatterproof1 (SHELL) shell thickness gene
atatattaagctaccaactataccrgtatgtagaacacatgatatgtgct

SEQ ID NO: 7423 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatgtagaacacatgatatgtgctktacctcctccatcatttgcaatgat

SEQ ID NO: 7424 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttgagataaatacaatcgacctgygcttatctctataaatttatgtctc

SEQ ID NO: 7425 - DNA, 50 bp, Artificial Sequence
  synthetic Elaeis guineensis (oil palm) single nucleotide polymorphism (SNP) in genomic region adjacent to shatterproof1 (SHELL) shell thickness gene
tccaaatttttcattttaaattcaycattcaatataattaaagtttcaac

SEQ ID NO: 7426 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctgcatgcttcgagatctccactwtataaaatggtccaattttggctct

SEQ ID NO: 7427 - DNA, 50 bp, Artificial Sequence
  synthetic Elaeis guineensis (oil palm) single nucleotide polymorphism (SNP) in genomic region adjacent to shatterproof1 (SHELL) shell thickness gene
tggatgtgtgaaaaatgtagtagtmtcacactatatattgtttaacagaa

SEQ ID NO: 7428 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagtggtataaggtgaagccagatrtggaggagtctagttggctattgcc

SEQ ID NO: 7429 - DNA, 50 bp, Artificial Sequence
  synthetic Elaeis guineensis (oil palm) single nucleotide polymorphism (SNP) in genomic region adjacent to shatterproof1 (SHELL) shell thickness gene
atctatgcggatgtatatttaatcycacattaattattcaccgaaagatc

SEQ ID NO: 7430 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttaatctcacattaattattcacygaaagatcttgaatacttatatagg

SEQ ID NO: 7431 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggatgaggtcctaaattattatacytagctaattaggtatgcaactccat

SEQ ID NO: 7432 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatgcaactccatccaatctttgtrgcatatgcagggtggatgtctggcc

SEQ ID NO: 7433 - DNA, 50 bp, Artificial Sequence
  synthetic Elaeis guineensis (oil palm) single nucleotide polymorphism (SNP) in genomic region adjacent to shatterproof1 (SHELL) shell thickness gene
tccatccaatctttgtagcatatgyagggtggatgtctggccagaacacc

SEQ ID NO: 7434 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagaaagaagaaataaacagaaaayaatcaaatacgtggatcagccaaaa

SEQ ID NO: 7435 - DNA, 50 bp, Artificial Sequence
  synthetic Elaeis guineensis (oil palm) single nucleotide polymorphism (SNP) in genomic region adjacent to shatterproof1 (SHELL) shell thickness gene
tggggcatgcaaacttcactatgaraaaataaatattacaagaggagatc

SEQ ID NO: 7436 - DNA, 50 bp, Artificial Sequence
  synthetic Elaeis guineensis (oil palm) single nucleotide polymorphism (SNP) in genomic region adjacent to shatterproof1 (SHELL) shell thickness gene
gttcactatttcctggtttccatgygaagacgtccacgcccatgaaacca

SEQ ID NO: 7437 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctcctaatcaacctcaaatcaagtyccaaaccgttggatcaagatcagga

SEQ ID NO: 7438 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcgcactccgatctatgaaatagtrccgtggaccgtaagaaatagatgag

SEQ ID NO: 7439 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggaccgtaagaaatagatgagaaayggctctgcggtccacgtgctcctct

SEQ ID NO: 7440 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctgccgttgctccaccggcccgccrccggccgccgatggtcctccaccac

SEQ ID NO: 7441 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttcaaacgtatgtatctcctccgtycgagctctgtttgagatgatcttgg

SEQ ID NO: 7442 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttcactgtgagctcaatgtggattraattttgaggcatcaaatcctaaca

SEQ ID NO: 7443 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatcaactgctgatcatagattgayaaatataggagtcgagccaggccac

SEQ ID NO: 7444 - DNA, 50 bp, Artificial Sequence
  synthetic Elaeis guineensis (oil palm) single nucleotide polymorphism (SNP) in genomic region adjacent to shatterproof1 (SHELL) shell thickness gene
gctgtgcttctcctaacttaagacmtgctcggggtatcatcctacagcaa

SEQ ID NO: 7445 - DNA, 50 bp, Artificial Sequence
  synthetic Elaeis guineensis (oil palm) single nucleotide polymorphism (SNP) in genomic region adjacent to shatterproof1 (SHELL) shell thickness gene
atagcctcttgaattcagtctgctyaatgagataagatttcatctaaaat

SEQ ID NO: 7446 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcttaatgagataagatttcatctraaatcagatatgtatcgaacctccc

SEQ ID NO: 7447 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatcagatatgtatcgaacctcccycaatcttcttactgcaccatcatgt

SEQ ID NO: 7448 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtcctctagctgaccatcccgatgyctctgatagcgcagctcgatctatc

SEQ ID NO: 7449 - DNA, 50 bp, Artificial Sequence
  synthetic Elaeis guineensis (oil palm) single nucleotide polymorphism (SNP) in genomic region adjacent to shatterproof1 (SHELL) shell thickness gene
cgatctatccgacagataaatagtrtcttcactgttctctaaggagtcaa

SEQ ID NO: 7450 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcagaatctaatatccactgttggraagaagtagatacctcgtcagatgg

SEQ ID NO: 7451 - DNA, 50 bp, Artificial Sequence
  synthetic Elaeis guineensis (oil palm) single nucleotide polymorphism (SNP) in genomic region adjacent to shatterproof1 (SHELL) shell thickness gene
cagatggctccaagatatctccctytgaattgttactggccgtcgccaca

SEQ ID NO: 7452 - DNA, 50 bp, Artificial Sequence
  synthetic Elaeis guineensis (oil palm) single nucleotide polymorphism (SNP) in genomic region adjacent to shatterproof1 (SHELL) shell thickness gene
tccaagatatctccctctgaattgytactggccgtcgccacagcagtcat

SEQ ID NO: 7453 - DNA, 50 bp, Artificial Sequence
  synthetic Elaeis guineensis (oil palm) single nucleotide polymorphism (SNP) in genomic region adjacent to shatterproof1 (SHELL) shell thickness gene
aattgttactggccgtcgccacagyagtcatcgtctgatttttgaattga

SEQ ID NO: 7454 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgttactggccgtcgccacagcagycatcgtctgatttttgaattgagag

SEQ ID NO: 7455 - DNA, 50 bp, Artificial Sequence
  synthetic Elaeis guineensis (oil palm) single nucleotide polymorphism (SNP) in genomic region adjacent to shatterproof1 (SHELL) shell thickness gene
aactcgtcacactggtaacacctgrtcttgctcaagtctctcatggactt

SEQ ID NO: 7456 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagtctctcatggacttggaccgcyctcgtcgcgatctcctatcacacca

SEQ ID NO: 7457 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggaccgctctcgtcgcgatctcctrtcacaccatctactgcctcctgctc

SEQ ID NO: 7458 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcttgatggtgctcttctccactaraagagcagtcaccaaggactcgtac

SEQ ID NO: 7459 - DNA, 50 bp, Artificial Sequence
  synthetic Elaeis guineensis (oil palm) single nucleotide polymorphism (SNP) in genomic region adjacent to shatterproof1 (SHELL) shell thickness gene
gagagacttcgctatatacaactcytcgagcttcaaccacagcaccattg

SEQ ID NO: 7460 - DNA, 50 bp, Artificial Sequence
  synthetic Elaeis guineensis (oil palm) single nucleotide polymorphism (SNP) in genomic region adjacent to shatterproof1 (SHELL) shell thickness gene
gatcaccacctcatccgtcaggaayatgtggatggtactcactgcctgca

SEQ ID NO: 7461 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctcattagactctgtttttaatcrcggacctcgctgtagaattaatata

SEQ ID NO: 7462 - DNA, 50 bp, Artificial Sequence
  synthetic Elaeis guineensis (oil palm) single nucleotide polymorphism (SNP) in genomic region adjacent to shatterproof1 (SHELL) shell thickness gene
attaatatagatcaaatctcaagaygtcaaatcttaacgacatatgcttt

SEQ ID NO: 7463 - DNA, 50 bp, Artificial Sequence
  synthetic Elaeis guineensis (oil palm) single nucleotide polymorphism (SNP) in genomic region adjacent to shatterproof1 (SHELL) shell thickness gene
agatcaaatctcaagacgtcaaatyttaacgacatatgcttttataccca

SEQ ID NO: 7464 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttatacccatccaatctttgtggyaagctccaacctacgtgttttcatc

SEQ ID NO: 7465 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctttgtggcaagctccaacctacrtgttttcatcgagaacttgcactac

SEQ ID NO: 7466 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggctcttaaacccctggactggctsaaaatggttggccctactttaatct

SEQ ID NO: 7467 - DNA, 50 bp, Artificial Sequence
  synthetic Elaeis guineensis (oil palm) single nucleotide polymorphism (SNP) in genomic region adjacent to shatterproof1 (SHELL) shell thickness gene
agaagaagagacggagaacgttgtyctcttctctctcttccttttattta

SEQ ID NO: 7468 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttaaaattttttttcactagattrttttctctaggagtctcgtagacta

SEQ ID NO: 7469 - DNA, 50 bp, Artificial Sequence
  synthetic Elaeis guineensis (oil palm) single nucleotide polymorphism (SNP) in genomic region adjacent to shatterproof1 (SHELL) shell thickness gene
tagattattttctctaggagtctcrtagactagtggagggtccaagtact

SEQ ID NO: 7470 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttaaattttagttgaccgtaggaaragtcctggatttataatattaggat

SEQ ID NO: 7471 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaattttagttgaccgtaggaagartcctggatttataatattaggatca

SEQ ID NO: 7472 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttttatttcgagttcatagatcgargagttcatcgatttctgtatatggg

SEQ ID NO: 7473 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtatcatatgtttatatcaaacaayaattatttttcggatggtttgggat

SEQ ID NO: 7474 - DNA, 50 bp, Artificial Sequence
  synthetic Elaeis guineensis (oil palm) single nucleotide polymorphism (SNP) in genomic region adjacent to shatterproof1 (SHELL) shell thickness gene
gacataaattaagacttaataaatkgatgatcaagagaggatatttgaac

SEQ ID NO: 7475 - DNA, 50 bp, Artificial Sequence
  synthetic Elaeis guineensis (oil palm) single nucleotide polymorphism (SNP) in genomic region adjacent to shatterproof1 (SHELL) shell thickness gene
acagatgcgtggtatttgaattttycactttaagctgaagcacagttatt

SEQ ID NO: 7476 - DNA, 50 bp, Artificial Sequence
  synthetic Elaeis guineensis (oil palm) single nucleotide polymorphism (SNP) in genomic region adjacent to shatterproof1 (SHELL) shell thickness gene
catgatcgtgattagtccaaaattytaaagataattatagattaatccag

SEQ ID NO: 7477 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccagattaagttaatgagatatggrtgataagatataaaccatgattaag

SEQ ID NO: 7478 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgaattgaggtcgataatgattatrggatattgagattgtaagaaatttt

SEQ ID NO: 7479 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttactctaccacgtgtgttgaagayaaagccaatgaaaaacataacatcg

SEQ ID NO: 7480 - DNA, 50 bp, Artificial Sequence
  synthetic Elaeis guineensis (oil palm) single nucleotide polymorphism (SNP) in genomic region adjacent to shatterproof1 (SHELL) shell thickness gene
ataagagaaattgttagttagaatygttctaccatgtatatcttagacta

SEQ ID NO: 7481 - DNA, 50 bp, Artificial Sequence
  synthetic Elaeis guineensis (oil palm) single nucleotide polymorphism (SNP) in genomic region adjacent to shatterproof1 (SHELL) shell thickness gene
gatgtgttgattttttattgaatartctaaggtacacatgacagagaaca

SEQ ID NO: 7482 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttttttattgaataatctaaggtasacatgacagagaacaatactaacca

SEQ ID NO: 7483 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcacattgttttatatgattggtcyacatagccaccacttctcaatgcat

SEQ ID NO: 7484 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatatcctatggcatattatgactkcttatacgccggatgtcataatatg

SEQ ID NO: 7485 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgcatgcaagatgtcataatatagrccaagatgttataatatagaagagg

SEQ ID NO: 7486 - DNA, 50 bp, Artificial Sequence
  synthetic Elaeis guineensis (oil palm) single nucleotide polymorphism (SNP) in genomic region adjacent to shatterproof1 (SHELL) shell thickness gene
acgacgaaaatacccttgctctttraaaaaaattatgatatcctgcgtca

SEQ ID NO: 7487 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttgtttctctacagaccattgaagyaccaaaaaggggttgatgttgaaga

SEQ ID NO: 7488 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctgggagataaagccacctcaggtwatccgaaatacaaatcaaaaagttg

SEQ ID NO: 7489 - DNA, 50 bp, Artificial Sequence
  synthetic Elaeis guineensis (oil palm) single nucleotide polymorphism (SNP) in genomic region adjacent to shatterproof1 (SHELL) shell thickness gene
aggatttaaaaagatatatccaccrgagacaaaaggatgctcaccgcgct

SEQ ID NO: 7490 - DNA, 50 bp, Artificial Sequence
  synthetic Elaeis guineensis (oil palm) single nucleotide polymorphism (SNP) in genomic region adjacent to shatterproof1 (SHELL) shell thickness gene
cgctcttcgtatgtttctgatcttwgtatgtaagtagaggcaaacaagga

SEQ ID NO: 7491 - DNA, 50 bp, Artificial Sequence
  synthetic Elaeis guineensis (oil palm) single nucleotide polymorphism (SNP) in genomic region adjacent to shatterproof1 (SHELL) shell thickness gene
cctcaaaggtatgaataactctaartgctcactctctcccatttgttctc

SEQ ID NO: 7492 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttttaacttgagcattggagagtcyccactggagtcatctccagctaggg

SEQ ID NO: 7493 - DNA, 50 bp, Artificial Sequence
  synthetic Elaeis guineensis (oil palm) single nucleotide polymorphism (SNP) in genomic region adjacent to shatterproof1 (SHELL) shell thickness gene
actttatttgcagatcctactatcrtcgttctcgccgaacctcgatctac

SEQ ID NO: 7494 - DNA, 50 bp, Artificial Sequence
  synthetic Elaeis guineensis (oil palm) single nucleotide polymorphism (SNP) in genomic region adjacent to shatterproof1 (SHELL) shell thickness gene
tccagagcggacaatatctcacagyagaagctgagggggatgggggtagg

SEQ ID NO: 7495 - DNA, 50 bp, Artificial Sequence
  synthetic Elaeis guineensis (oil palm) single nucleotide polymorphism (SNP) in genomic region adjacent to shatterproof1 (SHELL) shell thickness gene
gagcggacaatatctcacagtagargctgagggggatgggggtaggaatt

SEQ ID NO: 7496 - DNA, 50 bp, Artificial Sequence
  synthetic Elaeis guineensis (oil palm) single nucleotide polymorphism (SNP) in genomic region adjacent to shatterproof1 (SHELL) shell thickness gene
gagtcatgttagagtggagggtgamtcccttactgtcatccgttggatcg

SEQ ID NO: 7497 - DNA, 50 bp, Artificial Sequence
  synthetic Elaeis guineensis (oil palm) single nucleotide polymorphism (SNP) in genomic region adjacent to shatterproof1 (SHELL) shell thickness gene
attgcatataaaatctgaaaaaaaytaaatataaaatcagcatgcatgca

SEQ ID NO: 7498 - DNA, 50 bp, Artificial Sequence
  synthetic Elaeis guineensis (oil palm) single nucleotide polymorphism (SNP) in genomic region adjacent to shatterproof1 (SHELL) shell thickness gene
cttttttcacaccatgaaaccatamccaagactcctctcaatgtgaagac

SEQ ID NO: 7499 - DNA, 50 bp, Artificial Sequence
  synthetic Elaeis guineensis (oil palm) single nucleotide polymorphism (SNP) in genomic region adjacent to shatterproof1 (SHELL) shell thickness gene
gttggcgacaaggtcttagagatawtgtcaaacattatctatatgatatc

SEQ ID NO: 7500 - DNA, 50 bp, Artificial Sequence
  synthetic Elaeis guineensis (oil palm) single nucleotide polymorphism (SNP) in genomic region adjacent to shatterproof1 (SHELL) shell thickness gene
taaaacctgctcgtatctaaatttrgatgtgagatagagaaggaaaagga

SEQ ID NO: 7501 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagaacctattggcgtatggttccrtataattcatttctttgatcctaat

SEQ ID NO: 7502 - DNA, 50 bp, Artificial Sequence
  synthetic Elaeis guineensis (oil palm) single nucleotide polymorphism (SNP) in genomic region adjacent to shatterproof1 (SHELL) shell thickness gene
gttccatataattcatttctttgaycctaatacttgaggacaatcaaaaa

SEQ ID NO: 7503 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttagaggagtcaatcccatcttgrctcatgtactgacttgacaagtact

SEQ ID NO: 7504 - DNA, 50 bp, Artificial Sequence
  synthetic Elaeis guineensis (oil palm) single nucleotide polymorphism (SNP) in genomic region adjacent to shatterproof1 (SHELL) shell thickness gene
gagtcaatcccatcttggctcatgyactgacttgacaagtacttgactgc

SEQ ID NO: 7505 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcttagattctttggaatatcctayaaaataatacatatagaattgagat

SEQ ID NO: 7506 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatcaaactatatctaacaaagttratttcaataagagagaatcttattt

SEQ ID NO: 7507 - DNA, 50 bp, Artificial Sequence
  synthetic Elaeis guineensis (oil palm) single nucleotide polymorphism (SNP) in genomic region adjacent to shatterproof1 (SHELL) shell thickness gene
catcggaaggacattctcctctttrttctgatcgaagagtttcaatgctc

SEQ ID NO: 7508 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatttatttttctatcttattatgraattatttgaatattttaaataatc

SEQ ID NO: 7509 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatgttcgtatatccaatacatcartatgtatcagactcagaacactatt

SEQ ID NO: 7510 - DNA, 50 bp, Artificial Sequence
  synthetic Elaeis guineensis (oil palm) single nucleotide polymorphism (SNP) in genomic region adjacent to shatterproof1 (SHELL) shell thickness gene
catgatcgagcctaaattgccaaarataggcttctaagatataatctact

SEQ ID NO: 7511 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcttagttgtccacatgattttgayatcattcataatgatatcacaaaaa

SEQ ID NO: 7512 - DNA, 50 bp, Artificial Sequence
  synthetic Elaeis guineensis (oil palm) single nucleotide polymorphism (SNP) in genomic region adjacent to shatterproof1 (SHELL) shell thickness gene
agacaatagtgacaatcaccaaaaygatattgatagaattgaaaataagc

SEQ ID NO: 7513 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgatagaattgaaaataagctcaaygattcttaaaatcaggattaaaaca

SEQ ID NO: 7514 - DNA, 50 bp, Artificial Sequence
  synthetic Elaeis guineensis (oil palm) single nucleotide polymorphism (SNP) in genomic region adjacent to shatterproof1 (SHELL) shell thickness gene
accgagacagtagtgttatagatakagaaatcacaaggtgttattatata

SEQ ID NO: 7515 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgatttttcttccttagcctgttcrgatcaaggaactctatcagactaga

SEQ ID NO: 7516 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctccttcaacatttgaaggatttcstcctactgaatattaacaaatttac

SEQ ID NO: 7517 - DNA, 50 bp, Artificial Sequence
  synthetic Elaeis guineensis (oil palm) single nucleotide polymorphism (SNP) in genomic region adjacent to shatterproof1 (SHELL) shell thickness gene
caacatttgaaggatttcctcctaytgaatattaacaaatttacaactaa

SEQ ID NO: 7518 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttctttgctgctctcaaaatacaayacatagtgatacgatcatttggcca

SEQ ID NO: 7519 - DNA, 50 bp, Artificial Sequence
  synthetic Elaeis guineensis (oil palm) single nucleotide polymorphism (SNP) in genomic region adjacent to shatterproof1 (SHELL) shell thickness gene
agaactatttgcaacttctgatacyatatatcaaagttgggtcctataaa

SEQ ID NO: 7520 - DNA, 50 bp, Artificial Sequence
  synthetic Elaeis guineensis (oil palm) single nucleotide polymorphism (SNP) in genomic region adjacent to shatterproof1 (SHELL) shell thickness gene
actatttgcaacttctgataccatmtatcaaagttgggtcctataaataa

SEQ ID NO: 7521 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaaaactcaagacctctatgtttrtgaattgattaagcctaaagacttg

SEQ ID NO: 7522 - DNA, 50 bp, Artificial Sequence
  synthetic Elaeis guineensis (oil palm) single nucleotide polymorphism (SNP) in genomic region adjacent to shatterproof1 (SHELL) shell thickness gene
atccacacaaactgcatacaagtcygaggatagttctgtcaactcatatg

SEQ ID NO: 7523 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctatgggtagattctcaactaattrtttcttcaaacaatttctagtaatt

SEQ ID NO: 7524 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttctcaactaattatttcttcaaayaatttctagtaattaattttatccc

SEQ ID NO: 7525 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcgatagatctccactaaaagtttyagttagatcaaaccattaacatgta

SEQ ID NO: 7526 - DNA, 50 bp, Artificial Sequence
  synthetic Elaeis guineensis (oil palm) single nucleotide polymorphism (SNP) in genomic region adjacent to shatterproof1 (SHELL) shell thickness gene
cataaattatgatattatttactarcgtattagttaaataccatgatagt

SEQ ID NO: 7527 - DNA, 50 bp, Artificial Sequence
  synthetic Elaeis guineensis (oil palm) single nucleotide polymorphism (SNP) in genomic region adjacent to shatterproof1 (SHELL) shell thickness gene
actccatcaggtcggattttggatkgttgcagatcgacactaaaaaaggg

SEQ ID NO: 7528 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctaagatcataaagttcaagaggamcagccactaatccacattcaaccaa

SEQ ID NO: 7529 - DNA, 50 bp, Artificial Sequence
  synthetic Elaeis guineensis (oil palm) single nucleotide polymorphism (SNP) in genomic region adjacent to shatterproof1 (SHELL) shell thickness gene
attccttgagagtccaatcctacawgctatgctaatttccatggtttttg

SEQ ID NO: 7530 - DNA, 50 bp, Artificial Sequence
  synthetic Elaeis guineensis (oil palm) single nucleotide polymorphism (SNP) in genomic region adjacent to shatterproof1 (SHELL) shell thickness gene
caatcctaaatggttacaacacaamtccaagctattaagatacgattcac

SEQ ID NO: 7531 - DNA, 50 bp, Artificial Sequence
  synthetic Elaeis guineensis (oil palm) single nucleotide polymorphism (SNP) in genomic region adjacent to shatterproof1 (SHELL) shell thickness gene
atcccctcgtcgcctggtcaccggraacaagtgcctgcaaaagaagtccg

SEQ ID NO: 7532 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcgcctggtcaccgggaacaagtgyctgcaaaagaagtccgcactgaccg

SEQ ID NO: 7533 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccctccgacggtcaagtcagagagragactaggcaacagtagaaaagaat

SEQ ID NO: 7534 - DNA, 50 bp, Artificial Sequence
  synthetic Elaeis guineensis (oil palm) single nucleotide polymorphism (SNP) in genomic region adjacent to shatterproof1 (SHELL) shell thickness gene
gggggagagagagggtaagcccaarggtttcaaaagaacctcctccagca

SEQ ID NO: 7535 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttttatagtagagcgtggtatggckccgtcattaatggcacagacaatga

SEQ ID NO: 7536 - DNA, 50 bp, Artificial Sequence
  synthetic Elaeis guineensis (oil palm) single nucleotide polymorphism (SNP) in genomic region adjacent to shatterproof1 (SHELL) shell thickness gene
gagtcgccgtggggctgtcaaatcrtcgtggggctgtcaaatcactaggg

SEQ ID NO: 7537 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttgggtggaacgatgtcccagggyggctacgccgcatgactttgtcagg

SEQ ID NO: 7538 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtttgggagagctggccgaccataygtcggtattcgctgtcgggacgtcg

SEQ ID NO: 7539 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggtgccttgcttaagtcggacgtcrgctgccacctccgacggtgagtcgg

SEQ ID NO: 7540 - DNA, 50 bp, Artificial Sequence
  synthetic Elaeis guineensis (oil palm) single nucleotide polymorphism (SNP) in genomic region adjacent to shatterproof1 (SHELL) shell thickness gene
cagttgcccccccactcctgagtcygatgtcatgttggctcgcgtgaata

SEQ ID NO: 7541 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccccccactcctgagtctgatgtcrtgttggctcgcgtgaatacgtgggc

SEQ ID NO: 7542 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcaacgaacgatccgatgtcggtcrtctcgactgtaggtcgagtgagcac

SEQ ID NO: 7543 - DNA, 50 bp, Artificial Sequence
  synthetic Elaeis guineensis (oil palm) single nucleotide polymorphism (SNP) in genomic region adjacent to shatterproof1 (SHELL) shell thickness gene
cattccgcaaagtcgagtagcgtcygacatattcagataggataacgatg

SEQ ID NO: 7544 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtggtaagccgaatatccttcgacygatcgtgaccaagtcggtatgtcgc

SEQ ID NO: 7545 - DNA, 50 bp, Artificial Sequence
  synthetic Elaeis guineensis (oil palm) single nucleotide polymorphism (SNP) in genomic region adjacent to shatterproof1 (SHELL) shell thickness gene
tagcatgtcgagtcgtatgatagayggtggcaagccgaatatccttcgac

SEQ ID NO: 7546 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagccgaatatccttcgaccggtcrtgaccgggtcggtatgtcgcaagtc

SEQ ID NO: 7547 - DNA, 50 bp, Artificial Sequence
  synthetic Elaeis guineensis (oil palm) single nucleotide polymorphism (SNP) in genomic region adjacent to shatterproof1 (SHELL) shell thickness gene
cgggtatgtcgcggttgtcttggcrttttgccctttcttagtcgaagcta

SEQ ID NO: 7548 - DNA, 50 bp, Artificial Sequence
  synthetic Elaeis guineensis (oil palm) single nucleotide polymorphism (SNP) in genomic region adjacent to shatterproof1 (SHELL) shell thickness gene
taagttggcaagttagccagccgcrttggtcgaagctttttgccctcaga

SEQ ID NO: 7549 - DNA, 50 bp, Artificial Sequence
  synthetic Elaeis guineensis (oil palm) single nucleotide polymorphism (SNP) in genomic region adjacent to shatterproof1 (SHELL) shell thickness gene
cataggccgtcggttcggtgatcgrtgatcgagctgttgattcgacgatc

SEQ ID NO: 7550 - DNA, 50 bp, Artificial Sequence
  synthetic Elaeis guineensis (oil palm) single nucleotide polymorphism (SNP) in genomic region adjacent to shatterproof1 (SHELL) shell thickness gene
cggttcggtgatcgatgatcgagcygttgattcgacgatcgacgatcgag

SEQ ID NO: 7551 - DNA, 50 bp, Artificial Sequence
  synthetic Elaeis guineensis (oil palm) single nucleotide polymorphism (SNP) in genomic region adjacent to shatterproof1 (SHELL) shell thickness gene
gattcgacgatcgacgatcgagccrtattggtcgaggcccttttgctttc

SEQ ID NO: 7552 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccatattggtcgaggcccttttgcyttcagaggtcgaggccgtctgttcg

SEQ ID NO: 7553 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttgctttcagaggtcgaggccgtcwgttcggcgatcggtgatcgaatcgt

SEQ ID NO: 7554 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcgatcgacgatcgagccatattgrtcaatgcccttttgccttcaaaggt

SEQ ID NO: 7555 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcaatgcccttttgccttcaaaggycgaggccgtcggttcggcgatcagt

SEQ ID NO: 7556 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtcgaggccgtcggttcggcgatcrgtgatcgagccgttgattcggtgat

SEQ ID NO: 7557 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcagtgatcgagccgttgattcggygatcgacgatcgagccgtattggtc

SEQ ID NO: 7558 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccttttgccttcagaggccgaggcmgtcggttcgacgatcgatgatcgag

SEQ ID NO: 7559 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcagaggccgaggcagtcggttcgrcgatcgatgatcgagccattgattc

SEQ ID NO: 7560 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccgaggcagtcggttcgacgatcgrtgatcgagccattgattcggcgatc

SEQ ID NO: 7561 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggttcgacgatcgatgatcgagccrttgattcggcgatcgacgatcgagc

SEQ ID NO: 7562 - DNA, 50 bp, Artificial Sequence
  synthetic Elaeis guineensis (oil palm) single nucleotide polymorphism (SNP) in genomic region adjacent to shatterproof1 (SHELL) shell thickness gene
atcgatgatcgagccattgattcgrcgatcgacgatcgagccgtattggt

SEQ ID NO: 7563 - DNA, 50 bp, Artificial Sequence
  synthetic Elaeis guineensis (oil palm) single nucleotide polymorphism (SNP) in genomic region adjacent to shatterproof1 (SHELL) shell thickness gene
cgaggcccttttgccttcagaggcygaggccgtcggttcggcaatcggtg

SEQ ID NO: 7564 - DNA, 50 bp, Artificial Sequence
  synthetic Elaeis guineensis (oil palm) single nucleotide polymorphism (SNP) in genomic region adjacent to shatterproof1 (SHELL) shell thickness gene
agaggctgaggccgtcggttcggcratcggtgatcgagccattgattcgg

SEQ ID NO: 7565 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggttcggcaatcggtgatcgagccrttgattcggcgatcgacgatttagc

SEQ ID NO: 7566 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccgaggccgtcggttcggcgatcgrtgatcaagccattgattcgacgatc

SEQ ID NO: 7567 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccgtcggttcggcgatcgatgatcragccattgattcgacgatcgacgat

SEQ ID NO: 7568 - DNA, 50 bp, Artificial Sequence
  synthetic Elaeis guineensis (oil palm) single nucleotide polymorphism (SNP) in genomic region adjacent to shatterproof1 (SHELL) shell thickness gene
gattcgacgatcgacgatcgagccrtattggtcgaggcccttttgccttc

SEQ ID NO: 7569 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttcgacgatcgacgatcgagccatrttggtcgaggcccttttgccttcag

SEQ ID NO: 7570 - DNA, 50 bp, Artificial Sequence
  synthetic Elaeis guineensis (oil palm) single nucleotide polymorphism (SNP) in genomic region adjacent to shatterproof1 (SHELL) shell thickness gene
cagaggccgaggccgtcggttcgaygatcgatgatcgagctgttgattcg

SEQ ID NO: 7571 - DNA, 50 bp, Artificial Sequence
  synthetic Elaeis guineensis (oil palm) single nucleotide polymorphism (SNP) in genomic region adjacent to shatterproof1 (SHELL) shell thickness gene
atcgatgatcgagctgttgattcgrcgatcgacgattgagccatattggt

SEQ ID NO: 7572 - DNA, 50 bp, Artificial Sequence
  synthetic Elaeis guineensis (oil palm) single nucleotide polymorphism (SNP) in genomic region adjacent to shatterproof1 (SHELL) shell thickness gene
cgagctgttgattcggcgatcgacrattgagccatattggtcgaggccct

SEQ ID NO: 7573 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcgaggcccttttgccttcagaggycgaggccgtcagttcgacgatcggt

SEQ ID NO: 7574 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttgccttcagaggccgaggccgtcrgttcgacgatcggtgatcgagtcgt

SEQ ID NO: 7575 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcagttcgacgatcggtgatcgagycgttgattcggcgatcgacgatcga

SEQ ID NO: 7576 - DNA, 50 bp, Artificial Sequence
  synthetic Elaeis guineensis (oil palm) single nucleotide polymorphism (SNP) in genomic region adjacent to shatterproof1 (SHELL) shell thickness gene
atcggtgatcgagtcgttgattcgrcgatcgacgatcgagccgtattggt

SEQ ID NO: 7577 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttcggcgatcgacgatcgagccgtrttggtcgaggcccttttgccttcag

SEQ ID NO: 7578 - DNA, 50 bp, Artificial Sequence
  synthetic Elaeis guineensis (oil palm) single nucleotide polymorphism (SNP) in genomic region adjacent to shatterproof1 (SHELL) shell thickness gene
gattcggcgatcgacgatcgagccrtattggtcgaggcccttttgccttc

SEQ ID NO: 7579 - DNA, 50 bp, Artificial Sequence; identical to SEQ ID NO: 7577
  synthetic Elaeis guineensis (oil palm) single nucleotide polymorphism (SNP) in genomic region adjacent to shatterproof1 (SHELL) shell thickness gene

SEQ ID NO: 7580 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcgatcgacgatcgagccgtattgrtcgaggcccttttgccttcagaggc

SEQ ID NO: 7581 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaggccgaggccgttggtgattgarccattgattcgacgatcgacgatcg

SEQ ID NO: 7582 - DNA, 50 bp, Artificial Sequence
  synthetic Elaeis guineensis (oil palm) single nucleotide polymorphism (SNP) in genomic region adjacent to shatterproof1 (SHELL) shell thickness gene
agccatattggtcgaggcccttttrccttcagaggccgaggccgtcggtt

SEQ ID NO: 7583 - DNA, 50 bp, Artificial Sequence
  synthetic Elaeis guineensis (oil palm) single nucleotide polymorphism (SNP) in genomic region adjacent to shatterproof1 (SHELL) shell thickness gene
cagaggccgaggccgtcggttcgaygatctgtgatcgagctgttgattcg

SEQ ID NO: 7584 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggccaaggctgtcgtagatactccrctccttcgatctctatcaggatctg

SEQ ID NO: 7585 - DNA, 50 bp, Artificial Sequence
  synthetic Elaeis guineensis (oil palm) single nucleotide polymorphism (SNP) in genomic region adjacent to shatterproof1 (SHELL) shell thickness gene
aggagtcatacctgcgatgcatcgrtctcggactccgtcgtcggggcaag

SEQ ID NO: 7586 - DNA, 50 bp, Artificial Sequence
  synthetic Elaeis guineensis (oil palm) single nucleotide polymorphism (SNP) in genomic region adjacent to shatterproof1 (SHELL) shell thickness gene
cagacgtcggttggaagctccttcrtctgcgcgcatgtatttgtacgcgc

SEQ ID NO: 7587 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtcggaggttcatggaggcttccgrctggtgctgaaatgggccacgaaag

SEQ ID NO: 7588 - DNA, 50 bp, Artificial Sequence
  synthetic Elaeis guineensis (oil palm) single nucleotide polymorphism (SNP) in genomic region adjacent to shatterproof1 (SHELL) shell thickness gene
taaaccgactagggatcggctcatygaggatgagtcgggagagaggttgg

SEQ ID NO: 7589 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttctgtccgtccacctgcagctggrcaagctgatggttgatttcttcgaa

SEQ ID NO: 7590 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaccccgggggtggagtctcccgaygaatctgagagggaggcggacggtg

SEQ ID NO: 7591 - DNA, 50 bp, Artificial Sequence
  synthetic Elaeis guineensis (oil palm) single nucleotide polymorphism (SNP) in genomic region adjacent to shatterproof1 (SHELL) shell thickness gene
gttccagctgggaaggagatggtcrtcgggatcggtgggcatcatgttgt

SEQ ID NO: 7592 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcgggtgtgccgtcggttgctccgycggtgagtgtggcaactgggttggt

SEQ ID NO: 7593 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttgctccgccggtgagtgtggcaaytgggttggttgctgttgaaggctct

SEQ ID NO: 7594 - DNA, 50 bp, Artificial Sequence
  synthetic Elaeis guineensis (oil palm) single nucleotide polymorphism (SNP) in genomic region adjacent to shatterproof1 (SHELL) shell thickness gene
agcacggtcatctgccgcacgatcrtcgcgaactgcacctccgtggtcac

SEQ ID NO: 7595 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgtggccaatctcctcgtcgcctgrtcatcggaaacgagtgcctgcaaaa

SEQ ID NO: 7596 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatctcctcgtcgcctgatcatcgraaacgagtgcctgcaaaagaagtcc

SEQ ID NO: 7597 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcctcgtcgcctgatcatcggaaaygagtgcctgcaaaagaagtccgcac

SEQ ID NO: 7598 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggagagagagagggtaagcccaagrgtttcgaaagaacctcttccagcac

SEQ ID NO: 7599 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcatcggaggctgtcagagtcaccrtggggttgtcaaatcactgtggggc

SEQ ID NO: 7600 - DNA, 50 bp, Artificial Sequence
  synthetic Elaeis guineensis (oil palm) single nucleotide polymorphism (SNP) in genomic region adjacent to shatterproof1 (SHELL) shell thickness gene
gactgtcaaatcactagggttgacycatgtcttgggtgggacgatgtccc

SEQ ID NO: 7601 - DNA, 50 bp, Artificial Sequence
  synthetic Elaeis guineensis (oil palm) single nucleotide polymorphism (SNP) in genomic region adjacent to shatterproof1 (SHELL) shell thickness gene
catgtcttgggtgggacgatgtccyagggcggctacgccgcatgcctttg

SEQ ID NO: 7602 - DNA, 50 bp, Artificial Sequence
  synthetic Elaeis guineensis (oil palm) single nucleotide polymorphism (SNP) in genomic region adjacent to shatterproof1 (SHELL) shell thickness gene
taatatgggttcgaccgctcagtcrgtcggaaacaacatgggtcggttcg

SEQ ID NO: 7603 - DNA, 50 bp, Artificial Sequence
  synthetic Elaeis guineensis (oil palm) single nucleotide polymorphism (SNP) in genomic region adjacent to shatterproof1 (SHELL) shell thickness gene
agttggacgtccgtcggagtcgtcygtcggtcgtcgatcagatcggtccg

SEQ ID NO: 7604 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtcgtccgtcggtcgtcgatcagaycggtccgagagtaagtcggcgtatg

SEQ ID NO: 7605 - DNA, 50 bp, Artificial Sequence
  synthetic Elaeis guineensis (oil palm) single nucleotide polymorphism (SNP) in genomic region adjacent to shatterproof1 (SHELL) shell thickness gene
cgtcggtcgtcgatcagatcggtcygagagtaagtcggcgtatgggggtc

SEQ ID NO: 7606 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcagtcggtatatcccaataacctytaagataatagaaaaaggtctcggc

SEQ ID NO: 7607 - DNA, 50 bp, Artificial Sequence
  synthetic Elaeis guineensis (oil palm) single nucleotide polymorphism (SNP) in genomic region adjacent to shatterproof1 (SHELL) shell thickness gene
cgaaaaagcctcagcttgactgatyagaggagtcatcctaggattgactg

SEQ ID NO: 7608 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaaaaagcctcagcttgactgatcrgaggagtcatcctaggattgactga

SEQ ID NO: 7609 - DNA, 50 bp, Artificial Sequence
  synthetic Elaeis guineensis (oil palm) single nucleotide polymorphism (SNP) in genomic region adjacent to shatterproof1 (SHELL) shell thickness gene
cctaggattgactgaaacttttaarataaaaagaagtcttcgtatgacca

SEQ ID NO: 7610 - DNA, 50 bp, Artificial Sequence
  synthetic Elaeis guineensis (oil palm) single nucleotide polymorphism (SNP) in genomic region adjacent to shatterproof1 (SHELL) shell thickness gene
attagcgatgacaattttatcatcmtaataatattttttattgataataa

SEQ ID NO: 7611 - DNA, 50 bp, Artificial Sequence
  synthetic Elaeis guineensis (oil palm) single nucleotide polymorphism (SNP) in genomic region adjacent to shatterproof1 (SHELL) shell thickness gene
agtgatggtatttttgatttttaaygacagctaattacgtcactaataaa

SEQ ID NO: 7612 - DNA, 50 bp, Artificial Sequence
  synthetic Elaeis guineensis (oil palm) single nucleotide polymorphism (SNP) in genomic region adjacent to shatterproof1 (SHELL) shell thickness gene
gatggtatttttgatttttaatgayagctaattacgtcactaataaaaaa

SEQ ID NO: 7613 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttgattcaagaattattagtgacrgagttatcttattagcaatggtatt

SEQ ID NO: 7614 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtgacagagttatcttattagcaayggtattttaccgtcactaataacct

SEQ ID NO: 7615 - DNA, 50 bp, Artificial Sequence
  synthetic Elaeis guineensis (oil palm) single nucleotide polymorphism (SNP) in genomic region adjacent to shatterproof1 (SHELL) shell thickness gene
acgatttttatctaattgtgtgccycaattttccccacccccctctcatt

SEQ ID NO: 7616 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccgagcatccaaatcctatttttcyccatcgacggccgactgactgctgg

SEQ ID NO: 7617 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagccccgactgcctcctcgagccyccgtccaccgaatccaagcccctcg

SEQ ID NO: 7618 - DNA, 50 bp, Artificial Sequence
  synthetic Elaeis guineensis (oil palm) single nucleotide polymorphism (SNP) in genomic region adjacent to shatterproof1 (SHELL) shell thickness gene
cgtcgtcagatccggctttcccaarctgtcggccgcctcctcgagccccg

SEQ ID NO: 7619 - DNA, 50 bp, Artificial Sequence
  synthetic Elaeis guineensis (oil palm) single nucleotide polymorphism (SNP) in genomic region adjacent to shatterproof1 (SHELL) shell thickness gene
atttccatcaacctcatcggtcgtygcctcaccacgccacctcaccacac

SEQ ID NO: 7620 - DNA, 50 bp, Artificial Sequence
  synthetic Elaeis guineensis (oil palm) single nucleotide polymorphism (SNP) in genomic region adjacent to shatterproof1 (SHELL) shell thickness gene
caacatatatatccctgtattggtrtttgctttcatgcctatctaataaa

SEQ ID NO: 7621 - DNA, 50 bp, Artificial Sequence
  synthetic Elaeis guineensis (oil palm) single nucleotide polymorphism (SNP) in genomic region adjacent to shatterproof1 (SHELL) shell thickness gene
aattatctttattttttaaaattgrtcgaactgagagaagaaaccaggtt

SEQ ID NO: 7622 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttatctttattttttaaaattggtygaactgagagaagaaaccaggttaa

SEQ ID NO: 7623 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctctgttcttttatgcaatttgtcrgacaccttagattctatctatttat

SEQ ID NO: 7624 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctagccatcggagcactacgttgtyagacccgcaatgtcagacccgcacc

SEQ ID NO: 7625 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgtcagacccgcaatgtcagacccrcaccaccttgcaccgtgagtattaa

SEQ ID NO: 7626 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcaccatcgtcacaccccattttcwtctttttaaattttaaatatttaaa

SEQ ID NO: 7627 - DNA, 50 bp, Artificial Sequence
  synthetic Elaeis guineensis (oil palm) single nucleotide polymorphism (SNP) in genomic region adjacent to shatterproof1 (SHELL) shell thickness gene
catctttttaaattttaaatatttwaaattagatttatttgattatttta

SEQ ID NO: 7628 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttaaattttaaatatttaaaattaratttatttgattattttaaattaat

SEQ ID NO: 7629 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggctctgacccactcatctactctracggcgatcggagtaactcggcaat

SEQ ID NO: 7630 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgacccactcatctactctgacggygatcggagtaactcggcaattgaat

SEQ ID NO: 7631 - DNA, 50 bp, Artificial Sequence
  synthetic Elaeis guineensis (oil palm) single nucleotide polymorphism (SNP) in genomic region adjacent to shatterproof1 (SHELL) shell thickness gene
cactcatctactctgacggcgatcrgagtaactcggcaattgaattctag

SEQ ID NO: 7632 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagcccaaaaaaaattttcggaccrgactcaaggaggccaacatgatacc

SEQ ID NO: 7633 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtatccctacgccacttctccattrtcgtcatccacttatcggatttcct

SEQ ID NO: 7634 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcctcctctatcgataaggtgaggyagctttggaaggtatgttattccgt

SEQ ID NO: 7635 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttgatactctcagattcgaacaatrtggagtcaccagtagctccacattt

SEQ ID NO: 7636 - DNA, 50 bp, Artificial Sequence
  synthetic Elaeis guineensis (oil palm) single nucleotide polymorphism (SNP) in genomic region adjacent to shatterproof1 (SHELL) shell thickness gene
agctccacatttacatggagcagtktccaactctcagagcaggtaagttt

SEQ ID NO: 7637 - DNA, 50 bp, Artificial Sequence
  synthetic Elaeis guineensis (oil palm) single nucleotide polymorphism (SNP) in genomic region adjacent to shatterproof1 (SHELL) shell thickness gene
agtaaaggttcaaggtcagaccacmatcgaactgactctatcccgatggt

SEQ ID NO: 7638 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcatcgtgatggggacagatcattrcaataattgatcttcaacgtgataa

SEQ ID NO: 7639 - DNA, 50 bp, Artificial Sequence
  synthetic Elaeis guineensis (oil palm) single nucleotide polymorphism (SNP) in genomic region adjacent to shatterproof1 (SHELL) shell thickness gene
tggggacagatcattgcaataattratcttcaacgtgataaactctaata

SEQ ID NO: 7640 - DNA, 50 bp, Artificial Sequence
  synthetic Elaeis guineensis (oil palm) single nucleotide polymorphism (SNP) in genomic region adjacent to shatterproof1 (SHELL) shell thickness gene
atttaatataatattctttatgatrtcttgatactctcaggttcagacga

SEQ ID NO: 7641 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtaagtctattaataatttttttayttattttaaatatctatatttagaa

SEQ ID NO: 7642 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcttcacatatctaggcttgagtcygaaaaaagaatctagggataaaaat

SEQ ID NO: 7643 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaaaaaagaatctagggataaaaawttaatctaaccattcaatcgatggg

SEQ ID NO: 7644 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatctaaccattcaatcgatgggcygggagtgtttatatcttcgtatcat

SEQ ID NO: 7645 - DNA, 50 bp, Artificial Sequence
  synthetic Elaeis guineensis (oil palm) single nucleotide polymorphism (SNP) in genomic region adjacent to shatterproof1 (SHELL) shell thickness gene
attcgaaaattagagtagtatatcraaatatatacctctgtatcgatata

SEQ ID NO: 7646 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaattagagtagtatatcgaaatayatacctctgtatcgatatatacact

SEQ ID NO: 7647 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcatccttcagctactagagaggaygtatagaggtaggaggaggatgaga

SEQ ID NO: 7648 - DNA, 50 bp, Artificial Sequence
  synthetic Elaeis guineensis (oil palm) single nucleotide polymorphism (SNP) in genomic region adjacent to shatterproof1 (SHELL) shell thickness gene
cagctactagagaggacgtatagargtaggaggaggatgagaaggatgat

SEQ ID NO: 7649 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttaattttatatttatgattatgtyaaataattattattttatttataaa

SEQ ID NO: 7650 - DNA, 50 bp, Artificial Sequence
  synthetic Elaeis guineensis (oil palm) single nucleotide polymorphism (SNP) in genomic region adjacent to shatterproof1 (SHELL) shell thickness gene
acggtagtagtaacgataaaggccrttgctaataattttttgatatttta

SEQ ID NO: 7651 - DNA, 50 bp, Artificial Sequence
  synthetic Elaeis guineensis (oil palm) single nucleotide polymorphism (SNP) in genomic region adjacent to shatterproof1 (SHELL) shell thickness gene
tagcagcggcattccatcgctaatrctattagtgacgataaactgacaat

SEQ ID NO: 7652 - DNA, 50 bp, Artificial Sequence
  synthetic Elaeis guineensis (oil palm) single nucleotide polymorphism (SNP) in genomic region adjacent to shatterproof1 (SHELL) shell thickness gene
acgataaactgacaattagtgacgrcaattagccgtcgctaattgtcaat

SEQ ID NO: 7653 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaggactaaagtttgccatatcaaycccctttctctatgaaattttggct

SEQ ID NO: 7654 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttatcgcattctgatcatataacrgtctacctttaaatgtcgttatacc

SEQ ID NO: 7655 - DNA, 50 bp, Artificial Sequence
  synthetic Elaeis guineensis (oil palm) single nucleotide polymorphism (SNP) in genomic region adjacent to shatterproof1 (SHELL) shell thickness gene
tattatggcattatgggcttatatygacatgtctccaagggcattatgat

SEQ ID NO: 7656 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctccccaacaccattcctggaaggsctgaagctactgagattctataaat

SEQ ID NO: 7657 - DNA, 50 bp, Artificial Sequence
  synthetic Elaeis guineensis (oil palm) single nucleotide polymorphism (SNP) in genomic region adjacent to shatterproof1 (SHELL) shell thickness gene
atatctgctttcactattctaaccrcattctttgttagtctatgcattat

SEQ ID NO: 7658 - DNA, 50 bp, Artificial Sequence
  synthetic Elaeis guineensis (oil palm) single nucleotide polymorphism (SNP) in genomic region adjacent to shatterproof1 (SHELL) shell thickness gene
agcgaagtccacaacagcaaaacayagatggaaaagcccataggtgtgca

SEQ ID NO: 7659 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaagcccataggtgtgcaagcctrcaagcgtggctcatgggcgcgcaag

SEQ ID NO: 7660 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcctgcaagcgtggctcatgggcgygcaaggcccgcaagcatgtggccca

SEQ ID NO: 7661 - DNA, 50 bp, Artificial Sequence
  synthetic Elaeis guineensis (oil palm) single nucleotide polymorphism (SNP) in genomic region adjacent to shatterproof1 (SHELL) shell thickness gene
agcatgtggcccacaagtgcacagrcccgcaggcgtgcatggccagtgcg

SEQ ID NO: 7662 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccacaagtgcacaggcccgcaggcrtgcatggccagtgcgtgtggcccaa

SEQ ID NO: 7663 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccgtggttcactgcacggttcatgygcggtctatggcaccatgcaggagg

SEQ ID NO: 7664 - DNA, 50 bp, Artificial Sequence
  synthetic Elaeis guineensis (oil palm) single nucleotide polymorphism (SNP) in genomic region adjacent to shatterproof1 (SHELL) shell thickness gene
cgcggttcatggaatggatgtgcgygatccaaaggtcgagatggtgtgca

SEQ ID NO: 7665 - DNA, 50 bp, Artificial Sequence
  synthetic Elaeis guineensis (oil palm) single nucleotide polymorphism (SNP) in genomic region adjacent to shatterproof1 (SHELL) shell thickness gene
caggggtgatccaattgtggctggkgtcttggactcccattaggactttg

SEQ ID NO: 7666 - DNA, 50 bp, Artificial Sequence
  synthetic Elaeis guineensis (oil palm) single nucleotide polymorphism (SNP) in genomic region adjacent to shatterproof1 (SHELL) shell thickness gene
cgctcgaaaagagaggattcatggycgagagcatcataggaagcatccag

SEQ ID NO: 7667 - DNA, 50 bp, Artificial Sequence
  synthetic Elaeis guineensis (oil palm) single nucleotide polymorphism (SNP) in genomic region adjacent to shatterproof1 (SHELL) shell thickness gene
acttctctaacagcgatgaaagttyaaggagatgtacatggtgaagtcac

SEQ ID NO: 7668 - DNA, 50 bp, Artificial Sequence
  synthetic Elaeis guineensis (oil palm) single nucleotide polymorphism (SNP) in genomic region adjacent to shatterproof1 (SHELL) shell thickness gene
gttcaaggagatgtacatggtgaastcacttaccaaaactctttttcttt

SEQ ID NO: 7669 - DNA, 50 bp, Artificial Sequence
  synthetic Elaeis guineensis (oil palm) single nucleotide polymorphism (SNP) in genomic region adjacent to shatterproof1 (SHELL) shell thickness gene
agagaagagcaccatcagatggatkaagttacttctatatttcttcagaa

SEQ ID NO: 7670 - DNA, 50 bp, Artificial Sequence
  synthetic Elaeis guineensis (oil palm) single nucleotide polymorphism (SNP) in genomic region adjacent to shatterproof1 (SHELL) shell thickness gene
aggtagtggcagaggataaaggggkaaaagatcgtaagatggatggtcca

SEQ ID NO: 7671 - DNA, 50 bp, Artificial Sequence
  synthetic Elaeis guineensis (oil palm) single nucleotide polymorphism (SNP) in genomic region adjacent to shatterproof1 (SHELL) shell thickness gene
cagaggataaaggggtaaaagatcrtaagatggatggtccagatccaaat

SEQ ID NO: 7672 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggatggatcgagctgtgtgatcaargatattagaactgtcagcttataga

SEQ ID NO: 7673 - DNA, 50 bp, Artificial Sequence
  synthetic Elaeis guineensis (oil palm) single nucleotide polymorphism (SNP) in genomic region adjacent to shatterproof1 (SHELL) shell thickness gene
agctcgaatttcatatttgtccatyaataagtagtcagatatttatccta

SEQ ID NO: 7674 - DNA, 50 bp, Artificial Sequence
  synthetic Elaeis guineensis (oil palm) single nucleotide polymorphism (SNP) in genomic region adjacent to shatterproof1 (SHELL) shell thickness gene
atttcatatttgtccattaataagyagtcagatatttatcctagggcatg

SEQ ID NO: 7675 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagctcttagagttagatagagacygaatgtcgaatcgagatggagattg

SEQ ID NO: 7676 - DNA, 50 bp, Artificial Sequence
  synthetic Elaeis guineensis (oil palm) single nucleotide polymorphism (SNP) in genomic region adjacent to shatterproof1 (SHELL) shell thickness gene
gatggagattgttagattttggcayctaaaatttgacccacagtagcaaa

SEQ ID NO: 7677 - DNA, 50 bp, Artificial Sequence
  synthetic Elaeis guineensis (oil palm) single nucleotide polymorphism (SNP) in genomic region adjacent to shatterproof1 (SHELL) shell thickness gene
cccagatggaggagcttgcaggggygcagggtgcaggcgcggcccatagg

SEQ ID NO: 7678 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgcaggcgcggcccataggcgtgcraggaccacagacgcgtaggcccaca

SEQ ID NO: 7679 - DNA, 50 bp, Artificial Sequence
  synthetic Elaeis guineensis (oil palm) single nucleotide polymorphism (SNP) in genomic region adjacent to shatterproof1 (SHELL) shell thickness gene
cgtaggcccacaagcatccaaggcyagcatgcatggcccgtagtaggcgg

SEQ ID NO: 7680 - DNA, 50 bp, Artificial Sequence
  synthetic Elaeis guineensis (oil palm) single nucleotide polymorphism (SNP) in genomic region adjacent to shatterproof1 (SHELL) shell thickness gene
agcacgcacgcatggcccaaaggcrcgggatgcatggcccagaccacatt

SEQ ID NO: 7681 - DNA, 50 bp, Artificial Sequence
  synthetic Elaeis guineensis (oil palm) single nucleotide polymorphism (SNP) in genomic region adjacent to shatterproof1 (SHELL) shell thickness gene
aacaaaaaaataactcaactcaatrctaaagttatgaatgttttatattg

SEQ ID NO: 7682 - DNA, 50 bp, Artificial Sequence
  synthetic Elaeis guineensis (oil palm) single nucleotide polymorphism (SNP) in genomic region adjacent to shatterproof1 (SHELL) shell thickness gene
cactaatcaagttaagaaactgtcytttatttgttatgaatgtaagaagt

SEQ ID NO: 7683 - DNA, 50 bp, Artificial Sequence
  synthetic Elaeis guineensis (oil palm) single nucleotide polymorphism (SNP) in genomic region adjacent to shatterproof1 (SHELL) shell thickness gene
caagaagtacaagaaaaagactatratggctacatgaagtgatagtgatg

SEQ ID NO: 7684 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatgactttatttttgaagaacttyaagaagcattttatgatctagttga

SEQ ID NO: 7685 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttatttttgaagaactttaagaagyattttatgatctagttgatgattta

SEQ ID NO: 7686 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctttgtgaactcatcaagcaacaartttttaaatattacttactttaaat

SEQ ID NO: 7687 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttttaaatattacttactttaaatrtagtaaagtaggacacaaatcatat

SEQ ID NO: 7688 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaattctaatgtgaagaaaatatgrgttccaaaagaaactattgtgacta

SEQ ID NO: 7689 - DNA, 50 bp, Artificial Sequence
  synthetic Elaeis guineensis (oil palm) single nucleotide polymorphism (SNP) in genomic region adjacent to shatterproof1 (SHELL) shell thickness gene
aggcacatgaccgatgatgaatctyaattcatcacacatgatgcaaaaga

SEQ ID NO: 7690 - DNA, 50 bp, Artificial Sequence
  synthetic Elaeis guineensis (oil palm) single nucleotide polymorphism (SNP) in genomic region adjacent to shatterproof1 (SHELL) shell thickness gene
agaaaagatcatcggtataagtaayattggtatgactccctctaagtata

SEQ ID NO: 7691 - DNA, 50 bp, Artificial Sequence
  synthetic Elaeis guineensis (oil palm) single nucleotide polymorphism (SNP) in genomic region adjacent to shatterproof1 (SHELL) shell thickness gene
catcggtataagtaacattggtatsactccctctaagtatattaaaaata

SEQ ID NO: 7692 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgaatgccaaaattaatgagactarttggttttggcaccgtaggcttgca

SEQ ID NO: 7693 - DNA, 50 bp, Artificial Sequence
  synthetic Elaeis guineensis (oil palm) single nucleotide polymorphism (SNP) in genomic region adjacent to shatterproof1 (SHELL) shell thickness gene
gttggttttggcaccgtaggcttgmacatattagtatgcattcactttta

SEQ ID NO: 7694 - DNA, 50 bp, Artificial Sequence
  synthetic Elaeis guineensis (oil palm) single nucleotide polymorphism (SNP) in genomic region adjacent to shatterproof1 (SHELL) shell thickness gene
aggccattagaattattgtacatgratttatttggacccactagaactac

SEQ ID NO: 7695 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttgtcattattgatgatttctctcrttttatataagcttttttttggcat

SEQ ID NO: 7696 - DNA, 50 bp, Artificial Sequence
  synthetic Elaeis guineensis (oil palm) single nucleotide polymorphism (SNP) in genomic region adjacent to shatterproof1 (SHELL) shell thickness gene
atgatttctctcattttatataagyttttttttggcatataaggatgaaa

SEQ ID NO: 7697 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttatgtgttctcaaaattttatcraaaagttactaatgaaaaaaatttt

SEQ ID NO: 7698 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcgaaaagttactaatgaaaaaaawtttttaattcaaaatattcaaagtg

SEQ ID NO: 7699 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaagtgatcatggaaccaaatttamaaatcaagaatttaaaaaattttgt

SEQ ID NO: 7700 - DNA, 50 bp, Artificial Sequence
  synthetic Elaeis guineensis (oil palm) single nucleotide polymorphism (SNP) in genomic region adjacent to shatterproof1 (SHELL) shell thickness gene
taaaaatttattgaaccaaattttraactcaattctcatctcttctttct

SEQ ID NO: 7701 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttctagccatgaatcgatcctaagrtaaacttgtaattttcattaaaatc

SEQ ID NO: 7702 - DNA, 50 bp, Artificial Sequence
  synthetic Elaeis guineensis (oil palm) single nucleotide polymorphism (SNP) in genomic region adjacent to shatterproof1 (SHELL) shell thickness gene
acactcttttttttgaaaaatctcygttagttaagcaggctgaccctttg

SEQ ID NO: 7703 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagtctctcttcccatcgggttttycccttcaatcgtccttttagaaact

SEQ ID NO: 7704 - DNA, 50 bp, Artificial Sequence
  synthetic Elaeis guineensis (oil palm) single nucleotide polymorphism (SNP) in genomic region adjacent to shatterproof1 (SHELL) shell thickness gene
gatcaagcttaccctagcttcaaaycctcttctccaaaccgatggtctat

SEQ ID NO: 7705 - DNA, 50 bp, Artificial Sequence
  synthetic Elaeis guineensis (oil palm) single nucleotide polymorphism (SNP) in genomic region adjacent to shatterproof1 (SHELL) shell thickness gene
agcttcaaaccctcttctccaaacygatggtctatctctccaaaatcttt

SEQ ID NO: 7706 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctacctctcattaggtcttctaarctgtttgcaagtctctcttgtctga

SEQ ID NO: 7707 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttgatccattacttttgggataaawcttgcacttgccttgtgaatgttat

SEQ ID NO: 7708 - DNA, 50 bp, Artificial Sequence
  synthetic Elaeis guineensis (oil palm) single nucleotide polymorphism (SNP) in genomic region adjacent to shatterproof1 (SHELL) shell thickness gene
atattattttaggaagagcatttaytaaaaatttaaataaattagaagca

SEQ ID NO: 7709 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttactaaaaatttaaataaattaraagcaaggatactttcagtaaagat

SEQ ID NO: 7710 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttagaagcaaggatactttcagtaragatgagacttttgcatcacatgat

SEQ ID NO: 7711 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccttcctactctgatgtttgaggcyatgagggagatcctaaataggtcta

SEQ ID NO: 7712 - DNA, 50 bp, Artificial Sequence
  synthetic Elaeis guineensis (oil palm) single nucleotide polymorphism (SNP) in genomic region adjacent to shatterproof1 (SHELL) shell thickness gene
caaagactgatggcggttggtcgamgggtgttgaggagagagcagaggag

SEQ ID NO: 7713 - DNA, 50 bp, Artificial Sequence
  synthetic Elaeis guineensis (oil palm) single nucleotide polymorphism (SNP) in genomic region adjacent to shatterproof1 (SHELL) shell thickness gene
agagcatctgctgatattcagttcrtgtttgatcacgagactggtccctc

SEQ ID NO: 7714 - DNA, 50 bp, Artificial Sequence
  synthetic Elaeis guineensis (oil palm) single nucleotide polymorphism (SNP) in genomic region adjacent to shatterproof1 (SHELL) shell thickness gene
agcatctgctgatattcagttcgtrtttgatcacgagactggtccctcag

SEQ ID NO: 7715 - DNA, 50 bp, Artificial Sequence
  synthetic Elaeis guineensis (oil palm) single nucleotide polymorphism (SNP) in genomic region adjacent to shatterproof1 (SHELL) shell thickness gene
attagccttagcccatctccaaccrtaagagaacatcatggaggtctcca

SEQ ID NO: 7716 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaacatcatggaggtctccaacctrtctacagaggcggctaggcttcgtg

SEQ ID NO: 7717 - DNA, 50 bp, Artificial Sequence
  synthetic Elaeis guineensis (oil palm) single nucleotide polymorphism (SNP) in genomic region adjacent to shatterproof1 (SHELL) shell thickness gene
aggtctccaacctgtctacagaggyggctaggcttcgtggcattttggag

SEQ ID NO: 7718 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcttcccaggctccaagaccttctygtccttctgctcgtgccggtacttc

SEQ ID NO: 7719 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtgccggtacttctacctgtggccraggcagatgtggtcgaggatgtgcc

SEQ ID NO: 7720 - DNA, 50 bp, Artificial Sequence
  synthetic Elaeis guineensis (oil palm) single nucleotide polymorphism (SNP) in genomic region adjacent to shatterproof1 (SHELL) shell thickness gene
catgatatttattagatctagcatwgttaatcttttatgtctaggatcta

SEQ ID NO: 7721 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatttattagatctagcattgttartcttttatgtctaggatctaactta

SEQ ID NO: 7722 - DNA, 50 bp, Artificial Sequence
  synthetic Elaeis guineensis (oil palm) single nucleotide polymorphism (SNP) in genomic region adjacent to shatterproof1 (SHELL) shell thickness gene
atccaattcaccccctctcctcttrggttgcatagctgggtaacagaggt

SEQ ID NO: 7723 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctcctcttaggttgcatagctgggyaacagaggtggatgtgcggtccatg

SEQ ID NO: 7724 - DNA, 50 bp, Artificial Sequence
  synthetic Elaeis guineensis (oil palm) single nucleotide polymorphism (SNP) in genomic region adjacent to shatterproof1 (SHELL) shell thickness gene
cgggggtgatccaacagtggctggkgtcttggactcctatcaggataatg

SEQ ID NO: 7725 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtgtggaagagaggcatagataacrgctaagagtatctgagagaagagga

SEQ ID NO: 7726 - DNA, 50 bp, Artificial Sequence
  synthetic Elaeis guineensis (oil palm) single nucleotide polymorphism (SNP) in genomic region adjacent to shatterproof1 (SHELL) shell thickness gene
gctaagagtatctgagagaagaggwttcatcgttgagagcatcatagaaa

SEQ ID NO: 7727 - DNA, 50 bp, Artificial Sequence
  synthetic Elaeis guineensis (oil palm) single nucleotide polymorphism (SNP) in genomic region adjacent to shatterproof1 (SHELL) shell thickness gene
agaggattcatcgttgagagcatcmtagaaagcatccaggggcatcagag

SEQ ID NO: 7728 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaagttttgtaagagcttttgtaargagttatgctttttattgagagaaa

SEQ ID NO: 7729 - DNA, 50 bp, Artificial Sequence
  synthetic Elaeis guineensis (oil palm) single nucleotide polymorphism (SNP) in genomic region adjacent to shatterproof1 (SHELL) shell thickness gene
atgccccatggagataagccttggrctaatccacgtatttgatcatgttc

SEQ ID NO: 7730 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttatcacataatctgtcggttgctytatatagacctcctcatcaatatag

SEQ ID NO: 7731 - DNA, 50 bp, Artificial Sequence
  synthetic Elaeis guineensis (oil palm) single nucleotide polymorphism (SNP) in genomic region adjacent to shatterproof1 (SHELL) shell thickness gene
atctcttcatctatggcatacttcyatattttactttttatagcatcttc

SEQ ID NO: 7732 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaagatgagctttgagcttttatcmtctagcttgactctcctctgcttca

SEQ ID NO: 7733 - DNA, 50 bp, Artificial Sequence
  synthetic Elaeis guineensis (oil palm) single nucleotide polymorphism (SNP) in genomic region adjacent to shatterproof1 (SHELL) shell thickness gene
caaaatatgtgcaaagctatacatytgaagatcttcatgtgtgagatatt

SEQ ID NO: 7734 - DNA, 50 bp, Artificial Sequence
  synthetic Elaeis guineensis (oil palm) single nucleotide polymorphism (SNP) in genomic region adjacent to shatterproof1 (SHELL) shell thickness gene
cccacaaaatacttcaaatgaattraaggtgaactcgccgcctcgatcta

SEQ ID NO: 7735 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttcaaatgaattgaaggtgaactcrccgcctcgatctaagcgaatgactt

SEQ ID NO: 7736 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcctcaagtgccacaatcatgaggyatcttttacatagagtttcaagcac

SEQ ID NO: 7737 - DNA, 50 bp, Artificial Sequence
  synthetic Elaeis guineensis (oil palm) single nucleotide polymorphism (SNP) in genomic region adjacent to shatterproof1 (SHELL) shell thickness gene
gatacagcaggaagaaagaagaaayaaaatagaaaataatcaaaatacgt

SEQ ID NO: 7738 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaggactcgcctccacggggcatrcaaactttactacgaaaaaaaaatt

SEQ ID NO: 7739 - DNA, 50 bp, Artificial Sequence
  synthetic Elaeis guineensis (oil palm) single nucleotide polymorphism (SNP) in genomic region adjacent to shatterproof1 (SHELL) shell thickness gene
ataaagttttttctcacaaaagctytctctcttaaaagaccccctgaatc

SEQ ID NO: 7740 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctctcttaaaagaccccctgaatcyctaaagcgaccattgttcgctgtcc

SEQ ID NO: 7741 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaagaccccctgaatccctaaagygaccattgttcgctgtccagaagcc

SEQ ID NO: 7742 - DNA, 50 bp, Artificial Sequence
  synthetic Elaeis guineensis (oil palm) single nucleotide polymorphism (SNP) in genomic region adjacent to shatterproof1 (SHELL) shell thickness gene
cgtcatacagaaaactcaagtcacrgattctgttttcatgagaaaccaag

SEQ ID NO: 7743 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcatgatcgatccacaaaatagtaycgtggaccgcacaaaatgcatggga

SEQ ID NO: 7744 - DNA, 50 bp, Artificial Sequence
  synthetic Elaeis guineensis (oil palm) single nucleotide polymorphism (SNP) in genomic region adjacent to shatterproof1 (SHELL) shell thickness gene
tagtatcgtggaccgcacaaaatgyatgggaaatgcccatgcagtccaca

SEQ ID NO: 7745 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaatgcccatgcagtccacagaccygaccgtggactgtccagtccactgt

SEQ ID NO: 7746 - DNA, 50 bp, Artificial Sequence
  synthetic Elaeis guineensis (oil palm) single nucleotide polymorphism (SNP) in genomic region adjacent to shatterproof1 (SHELL) shell thickness gene
catgcagtccacagacccgaccgtrgactgtccagtccactgtggatcgg

SEQ ID NO: 7747 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtgcgcctggcccatgtgctgccaygcactgggcggcatcccaccgccta

SEQ ID NO: 7748 - DNA, 50 bp, Artificial Sequence
  synthetic Elaeis guineensis (oil palm) single nucleotide polymorphism (SNP) in genomic region adjacent to shatterproof1 (SHELL) shell thickness gene
cactgggcggcatcccaccgcctayggtcgcaccgctatcactccgtcgg

SEQ ID NO: 7749 - DNA, 50 bp, Artificial Sequence
  synthetic Elaeis guineensis (oil palm) single nucleotide polymorphism (SNP) in genomic region adjacent to shatterproof1 (SHELL) shell thickness gene
tggactcaatatggatcaaatctcragatatcaaattctaacaatctcta

SEQ ID NO: 7750 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgacctgagacctactcaaggtatygtcctacggtaataggaatcccacc

SEQ ID NO: 7751 - DNA, 50 bp, Artificial Sequence
  synthetic Elaeis guineensis (oil palm) single nucleotide polymorphism (SNP) in genomic region adjacent to shatterproof1 (SHELL) shell thickness gene
attctcccgagtctcctgtctcgtrtccgatccagctccacttacagctc

SEQ ID NO: 7752 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctccttcttcccctccagcataatyctatcaccacgtagcaccttcagaa

SEQ ID NO: 7753 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtagcaccttcagaatttctccatyagctactgtcctgtagcctctcgaa

SEQ ID NO: 7754 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaaattggatatgtatcggatctcycctaatcttctcactataccatcat

SEQ ID NO: 7755 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctgaatcgctaccggccgtcgctayagcagccaccatccaatttttgagt

SEQ ID NO: 7756 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccggccgtcgctacagcagccaccrtccaatttttgagttgagagcaatc

SEQ ID NO: 7757 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggccgtcgctacagcagccaccatycaatttttgagttgagagcaatctt

SEQ ID NO: 7758 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccgtcctcatcgcgatctcctgtcrctccgtctaccaccttctgctcctc

SEQ ID NO: 7759 - DNA, 50 bp, Artificial Sequence
  synthetic Elaeis guineensis (oil palm) single nucleotide polymorphism (SNP) in genomic region adjacent to shatterproof1 (SHELL) shell thickness gene
cctcatcgcgatctcctgtcgctcygtctaccaccttctgctcctccaaa

SEQ ID NO: 7760 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcttctctactagaagagcagtcaycaaggactcgtatgaagatggaagt

SEQ ID NO: 7761 - DNA, 50 bp, Artificial Sequence
  synthetic Elaeis guineensis (oil palm) single nucleotide polymorphism (SNP) in genomic region adjacent to shatterproof1 (SHELL) shell thickness gene
tactcctgcatgctctgtccctcgrccatccgtagctgataaaactgcct

SEQ ID NO: 7762 - DNA, 50 bp, Artificial Sequence
  synthetic Elaeis guineensis (oil palm) single nucleotide polymorphism (SNP) in genomic region adjacent to shatterproof1 (SHELL) shell thickness gene
tagctgataaaactgcctccagagraaaagagtgctggtgagagacttca

SEQ ID NO: 7763 - DNA, 50 bp, Artificial Sequence
  synthetic Elaeis guineensis (oil palm) single nucleotide polymorphism (SNP) in genomic region adjacent to shatterproof1 (SHELL) shell thickness gene
agtgctggtgagagacttcaccatrtacaactcctcgagctttgatcaag

SEQ ID NO: 7764 - DNA, 50 bp, Artificial Sequence
  synthetic Elaeis guineensis (oil palm) single nucleotide polymorphism (SNP) in genomic region adjacent to shatterproof1 (SHELL) shell thickness gene
gagctttgatcaagcaccatcgggraagtctcgctcagcacatgaatcac

SEQ ID NO: 7765 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatcaccacctcatccgttaggtayatgcggatggtactcaccgcctgca

SEQ ID NO: 7766 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtatatgcggatggtactcaccgcytgcatctgtagccatttccaatccc

SEQ ID NO: 7767 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctatcttcagtcttgctcaccacygctgcaatctgcatccttgtaccac

SEQ ID NO: 7768 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccgcacgccccacgccaggctgtgmcctgcgtgcttggcccgtgcactgc

SEQ ID NO: 7769 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttaaaagtacgtatcttctctttycgagctccgtttggggtgttcttga

SEQ ID NO: 7770 - DNA, 50 bp, Artificial Sequence
  synthetic Elaeis guineensis (oil palm) single nucleotide polymorphism (SNP) in genomic region adjacent to shatterproof1 (SHELL) shell thickness gene
acgtatcttctcttttcgagctccrtttggggtgttcttgatcttgttgg

SEQ ID NO: 7771 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagatgctctcagattccttcatcygtaaggcttcaaattctccttgtag

SEQ ID NO: 7772 - DNA, 50 bp, Artificial Sequence
  synthetic Elaeis guineensis (oil palm) single nucleotide polymorphism (SNP) in genomic region adjacent to shatterproof1 (SHELL) shell thickness gene
agatgctctcagattccttcatccrtaaggcttcaaattctccttgtagc

SEQ ID NO: 7773 - DNA, 50 bp, Artificial Sequence
  synthetic Elaeis guineensis (oil palm) single nucleotide polymorphism (SNP) in genomic region adjacent to shatterproof1 (SHELL) shell thickness gene
attaacgcttttgtaggccagaatytcccacactttcttggaagttgttg

SEQ ID NO: 7774 - DNA, 50 bp, Artificial Sequence
  synthetic Elaeis guineensis (oil palm) single nucleotide polymorphism (SNP) in genomic region adjacent to shatterproof1 (SHELL) shell thickness gene
tccagaactatccaactaaaatttytaattcaaaattaagtttatctttt

SEQ ID NO: 7775 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtctgaaacttattttgtttgggtwttttttagatcagcttggatatacc

SEQ ID NO: 7776 - DNA, 50 bp, Artificial Sequence
  synthetic Elaeis guineensis (oil palm) single nucleotide polymorphism (SNP) in genomic region adjacent to shatterproof1 (SHELL) shell thickness gene
aacttattttgtttgggtttttttwagatcagcttggatatacctaatat

SEQ ID NO: 7777 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaaatagttaaaaaaatgaatgcartaagtcggatggatttggcaaggtc

SEQ ID NO: 7778 - DNA, 50 bp, Artificial Sequence
  synthetic Elaeis guineensis (oil palm) single nucleotide polymorphism (SNP) in genomic region adjacent to shatterproof1 (SHELL) shell thickness gene
cacgttggtatccgacgcgttcccrtccaaatccaacacgaagacgtagt

SEQ ID NO: 7779 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggccgccgtgatcgccggcgtcggmggcaggtggaggcgggtggcctcct

SEQ ID NO: 7780 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttctcttttggaatttacggctggkgaaatcagatcagctagtttatagg

SEQ ID NO: 7781 - DNA, 50 bp, Artificial Sequence
  synthetic Elaeis guineensis (oil palm) single nucleotide polymorphism (SNP) in genomic region adjacent to shatterproof1 (SHELL) shell thickness gene
atgagataatctggattgctaaggraagggatggctatccagattaccac

SEQ ID NO: 7782 - DNA, 50 bp, Artificial Sequence
  synthetic Elaeis guineensis (oil palm) single nucleotide polymorphism (SNP) in genomic region adjacent to shatterproof1 (SHELL) shell thickness gene
agataatctggattgctaagggaarggatggctatccagattaccaccac

SEQ ID NO: 7783 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgtgttcgcgcatggcccccgaccrccaccacaggtggaggaactcccga

SEQ ID NO: 7784 - DNA, 50 bp, Artificial Sequence
  synthetic Elaeis guineensis (oil palm) single nucleotide polymorphism (SNP) in genomic region adjacent to shatterproof1 (SHELL) shell thickness gene
aataagtattataaaatagtataawtttttttcatataataatttttatc

SEQ ID NO: 7785 - DNA, 50 bp, Artificial Sequence
  synthetic Elaeis guineensis (oil palm) single nucleotide polymorphism (SNP) in genomic region adjacent to shatterproof1 (SHELL) shell thickness gene
atattaccaataatctgattgtcakaccaaatatgtcaatcaagattctc

SEQ ID NO: 7786 - DNA, 50 bp, Artificial Sequence
  synthetic Elaeis guineensis (oil palm) single nucleotide polymorphism (SNP) in genomic region adjacent to shatterproof1 (SHELL) shell thickness gene
tagattattgggatagaaaattttyctactaacctacaaatcaaaattgt

SEQ ID NO: 7787 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcgacatagagctgaggctccataytgatggctatatttgatgtcatctc

SEQ ID NO: 7788 - DNA, 50 bp, Artificial Sequence
  synthetic Elaeis guineensis (oil palm) single nucleotide polymorphism (SNP) in genomic region adjacent to shatterproof1 (SHELL) shell thickness gene
cattttctatcttcggtgagatctraccataggattggtaatgttccgac

SEQ ID NO: 7789 - DNA, 50 bp, Artificial Sequence
  synthetic Elaeis guineensis (oil palm) single nucleotide polymorphism (SNP) in genomic region adjacent to shatterproof1 (SHELL) shell thickness gene
caaagagtcggtccgtcttgttttyttgactctctccgatgttcgaggta

SEQ ID NO: 7790 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccgacaggccaagtggagagatccracaatttggtagttgaatttatact

SEQ ID NO: 7791 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcaatgagttttggagtgaaaatcyctatggcaaccacaatcgtaggcca

SEQ ID NO: 7792 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggctggctcctcatccagggactaratctccacatcccatagtgcaggta

SEQ ID NO: 7793 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcctgtgtgcgagttcaaagatttytgcgattcaggtaacgaggagtcaa

SEQ ID NO: 7794 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgacgttctcctttatttaagaaawtttttttgattactactaaactaac

SEQ ID NO: 7795 - DNA, 50 bp, Artificial Sequence
  synthetic Elaeis guineensis (oil palm) single nucleotide polymorphism (SNP) in genomic region adjacent to shatterproof1 (SHELL) shell thickness gene
aggatagaaatggcagtcaaacggrtttttccgagtatctaacccattcc

SEQ ID NO: 7796 - DNA, 50 bp, Artificial Sequence
  synthetic Elaeis guineensis (oil palm) single nucleotide polymorphism (SNP) in genomic region adjacent to shatterproof1 (SHELL) shell thickness gene
tccatttgggtttggaatgggtttrggatttaacccttgggtacccacca

SEQ ID NO: 7797 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttaggatttaacccttgggtacccrccatccaaactcgtttatatataaa

SEQ ID NO: 7798 - DNA, 50 bp, Artificial Sequence
  synthetic Elaeis guineensis (oil palm) single nucleotide polymorphism (SNP) in genomic region adjacent to shatterproof1 (SHELL) shell thickness gene
tggggggaaggagagatccaaaggraggttggaggggtttttagattcca

SEQ ID NO: 7799 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggatttttatttaattttgtaatcrggtttgagatggattcaggtagaaa

SEQ ID NO: 7800 - DNA, 50 bp, Artificial Sequence
  synthetic Elaeis guineensis (oil palm) single nucleotide polymorphism (SNP) in genomic region adjacent to shatterproof1 (SHELL) shell thickness gene
taaacagcttcgaaaatgggtaggrcaaattttgtaggtatcctatccat

SEQ ID NO: 7801 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctccagcctcagcaccatcttcaakgatgtcaagtactgacccaatggaa

SEQ ID NO: 7802 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatagagtgcagagagattattctrctctttaaaatcatcagcttgcttg

SEQ ID NO: 7803 - DNA, 50 bp, Artificial Sequence
  synthetic Elaeis guineensis (oil palm) single nucleotide polymorphism (SNP) in genomic region adjacent to shatterproof1 (SHELL) shell thickness gene
agagattattctactctttaaaatyatcagcttgcttgggagtagatgag

SEQ ID NO: 7804 - DNA, 50 bp, Artificial Sequence
  synthetic Elaeis guineensis (oil palm) single nucleotide polymorphism (SNP) in genomic region adjacent to shatterproof1 (SHELL) shell thickness gene
gccaagtccaagctgttggttgccyaggagaaatttgaagctttagagga

SEQ ID NO: 7805 - DNA, 50 bp, Artificial Sequence
  synthetic Elaeis guineensis (oil palm) single nucleotide polymorphism (SNP) in genomic region adjacent to shatterproof1 (SHELL) shell thickness gene
cctagtgaggcactacagcaaaagrtggccgagcttgaaggagcattgga

SEQ ID NO: 7806 - DNA, 50 bp, Artificial Sequence
  synthetic Elaeis guineensis (oil palm) single nucleotide polymorphism (SNP) in genomic region adjacent to shatterproof1 (SHELL) shell thickness gene
cgagccgaccattgaaggcatcgcyatcggtcctgctaccgagcccattc

SEQ ID NO: 7807 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcaagatttgttacttcgatcaacstcttgagttggttagagtatagaaa

SEQ ID NO: 7808 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgatttgaaatcaaaattttcattrtcaatttgtgacgatcttgccaagt

SEQ ID NO: 7809 - DNA, 50 bp, Artificial Sequence
  synthetic Elaeis guineensis (oil palm) single nucleotide polymorphism (SNP) in genomic region adjacent to shatterproof1 (SHELL) shell thickness gene
agcctttgctcgattcattcatggmtaaggagcaccagatgccatatggg

SEQ ID NO: 7810 - DNA, 50 bp, Artificial Sequence
  synthetic Elaeis guineensis (oil palm) single nucleotide polymorphism (SNP) in genomic region adjacent to shatterproof1 (SHELL) shell thickness gene
atatgggatctctagaggattagtycctttataatcatcatcgaccttcg

SEQ ID NO: 7811 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccttcatagttgtcatcagcctccrctcaactcatccatagacaaagagt

SEQ ID NO: 7812 - DNA, 50 bp, Artificial Sequence
  synthetic Elaeis guineensis (oil palm) single nucleotide polymorphism (SNP) in genomic region adjacent to shatterproof1 (SHELL) shell thickness gene
atctgtggataaggagtgctaaatrgccatacgaggtctctggaggatta

SEQ ID NO: 7813 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgacccatctatgaacaaagagcgycagatagctatatggggtccctaga

SEQ ID NO: 7814 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccaagcattataatagtggtctacycattattgatatgatgccattttga

SEQ ID NO: 7815 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgatatgatgccattttgatctgakcttgcttcctagttttttcgaacaa

SEQ ID NO: 7816 - DNA, 50 bp, Artificial Sequence
  synthetic Elaeis guineensis (oil palm) single nucleotide polymorphism (SNP) in genomic region adjacent to shatterproof1 (SHELL) shell thickness gene
acaagttcaagttcatttgaagtcrgcccgaattctcttactcatcatag

SEQ ID NO: 7817 - DNA, 50 bp, Artificial Sequence
  synthetic Elaeis guineensis (oil palm) single nucleotide polymorphism (SNP) in genomic region adjacent to shatterproof1 (SHELL) shell thickness gene
gataagcccataataccttataaartttttcgatctagagccctttggct

SEQ ID NO: 7818 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatggattctaaataaaatcctagrccttcttcttgataatttaagccaa

SEQ ID NO: 7819 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatttatttggtgaaatagtcgacwgcaatgatcaaaaactttctctaac

SEQ ID NO: 7820 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctctaaccagtggtcatcaggaacrgcctgaggatgtcaatttctcacat

SEQ ID NO: 7821 - DNA, 50 bp, Artificial Sequence
  synthetic Elaeis guineensis (oil palm) single nucleotide polymorphism (SNP) in genomic region adjacent to shatterproof1 (SHELL) shell thickness gene
gacaataattagtgcaagctccatwgctggcctctgctagctattggcat

SEQ ID NO: 7822 - DNA, 50 bp, Artificial Sequence
  synthetic Elaeis guineensis (oil palm) single nucleotide polymorphism (SNP) in genomic region adjacent to shatterproof1 (SHELL) shell thickness gene
gctattggcataattctggcactgycgtcggttgtatcctattgtagagt

SEQ ID NO: 7823 - DNA, 50 bp, Artificial Sequence
  synthetic Elaeis guineensis (oil palm) single nucleotide polymorphism (SNP) in genomic region adjacent to shatterproof1 (SHELL) shell thickness gene
tagaggtagtgaatatgattttttrtaaagtctctcttctaagtaaacac

SEQ ID NO: 7824 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggtgcttgatcctctgagtttcaayaggactggttagtaaggcaccgtta

SEQ ID NO: 7825 - DNA, 50 bp, Artificial Sequence
  synthetic Elaeis guineensis (oil palm) single nucleotide polymorphism (SNP) in genomic region adjacent to shatterproof1 (SHELL) shell thickness gene
aacaggactggttagtaaggcaccrttaagaaggtagttgattagagggt

SEQ ID NO: 7826 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttctctgaccttggtatatgttgtwccttctaattttagaaggcctctaa

SEQ ID NO: 7827 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcctcgagcctcatattcttctcaratttattcgatgatgagttgcaagt

SEQ ID NO: 7828 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggcagtaaagtcgaatcaaagtgtmtattccatcacgtcccctatcgggc

SEQ ID NO: 7829 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaatcaaagtgtctattccatcacrtcccctatcgggcttgcaaggatga

SEQ ID NO: 7830 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcttggagagcaatgaggatgatcwgagatatcgtttgagctcttcaaat

SEQ ID NO: 7831 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaaactcttcatttgcctgaggatrttgaagaatggaaggtacttttttc

SEQ ID NO: 7832 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctgaggatattgaagaatggaaggyacttttttcgaccgacctcaaaatg

SEQ ID NO: 7833 - DNA, 50 bp, Artificial Sequence
  synthetic Elaeis guineensis (oil palm) single nucleotide polymorphism (SNP) in genomic region adjacent to shatterproof1 (SHELL) shell thickness gene
atccccatcagattaccataaatcytaaaaatttttttgatgtcacacca

SEQ ID NO: 7834 - DNA, 50 bp, Artificial Sequence
  synthetic Elaeis guineensis (oil palm) single nucleotide polymorphism (SNP) in genomic region adjacent to shatterproof1 (SHELL) shell thickness gene
catttagtttcacctcaacccaacmaatgcttcctccaaatcgatgatat

SEQ ID NO: 7835 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcatcatttgttagcaatacaaaayttaatcggttatgaatgccatcttc

SEQ ID NO: 7836 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttggaggccatttgaatctgattrtagtcggagaaagcattcatgaagc

SEQ ID NO: 7837 - DNA, 50 bp, Artificial Sequence
  synthetic Elaeis guineensis (oil palm) single nucleotide polymorphism (SNP) in genomic region adjacent to shatterproof1 (SHELL) shell thickness gene
agaggaagaaaaaagagagacaatyaaataacgtggattgactcaagact

SEQ ID NO: 7838 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttgactcaagacttatctccatggkgtatacaaacttcactataaaaaaa

SEQ ID NO: 7839 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctctcataaaactctcaactctcayaggaagatcctctcagctactatct

SEQ ID NO: 7840 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagatcctctcagctactatctctwagactctctgccgccacacatgata

SEQ ID NO: 7841 - DNA, 50 bp, Artificial Sequence
  synthetic Elaeis guineensis (oil palm) single nucleotide polymorphism (SNP) in genomic region adjacent to shatterproof1 (SHELL) shell thickness gene
taggattctaagtctaaaccgtgtytagaaccacctatagaccgcagtag

SEQ ID NO: 7842 - DNA, 50 bp, Artificial Sequence
  synthetic Elaeis guineensis (oil palm) single nucleotide polymorphism (SNP) in genomic region adjacent to shatterproof1 (SHELL) shell thickness gene
cagtagaccaccatagacccctccwcatgaatcgaagccatggaccagct

SEQ ID NO: 7843 - DNA, 50 bp, Artificial Sequence
  synthetic Elaeis guineensis (oil palm) single nucleotide polymorphism (SNP) in genomic region adjacent to shatterproof1 (SHELL) shell thickness gene
gccacatgtgccacgctcaccctcrctcgtgtgcatcgtgacaaagacca

SEQ ID NO: 7844 - DNA, 50 bp, Artificial Sequence
  synthetic Elaeis guineensis (oil palm) single nucleotide polymorphism (SNP) in genomic region adjacent to shatterproof1 (SHELL) shell thickness gene
cgctcaccctcgctcgtgtgcatcrtgacaaagaccatgcatcgtgcggt

SEQ ID NO: 7845 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcaactcccgcactcttggacagcrtggtggtccgtgcatctcgtgcagc

SEQ ID NO: 7846 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccgtgcatctcgtgcagcctgggcygtgcctgtgggcctgcgtacctatg

SEQ ID NO: 7847 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaggcatcaaaatctaataatctcyatcttgactcgacattcggcctcca

SEQ ID NO: 7848 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttcatatactatgacctgcttgacytgagatctgctcgaggtagcatcct

SEQ ID NO: 7849 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctccatctctagctgcttgaatcyagtctgcttagtgaaatcagattac

SEQ ID NO: 7850 - DNA, 50 bp, Artificial Sequence
  synthetic Elaeis guineensis (oil palm) single nucleotide polymorphism (SNP) in genomic region adjacent to shatterproof1 (SHELL) shell thickness gene
aacttgctcactgctccatcatatrtctacaagctaactgttccaatatc

SEQ ID NO: 7851 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaacatgctgaatctaaaatctacwaagaaaaagaagtagatatcttatc

SEQ ID NO: 7852 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctgccaccaccacctttagtcactkccaaagtcgagttgctatctgaatt

SEQ ID NO: 7853 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtcgagttgctatctgaatttgaarctcgattctctcatttgaagatctt

SEQ ID NO: 7854 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagtctcaataagcacatggatcaycatattatttatcaagaataagtag

SEQ ID NO: 7855 - DNA, 50 bp, Artificial Sequence
  synthetic Elaeis guineensis (oil palm) single nucleotide polymorphism (SNP) in genomic region adjacent to shatterproof1 (SHELL) shell thickness gene
accacctgcatctagagctgcttcraacttttatcctccatgatagtcga

SEQ ID NO: 7856 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaacttttatcctccatgatagtcratttttcttcgcacaagagagtatc

SEQ ID NO: 7857 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctctcgcttgctataggaagaaatractcttcccatcataccgattgatc

SEQ ID NO: 7858 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcctatcaggattctaagtccaaaytgtgtccagagccgcctatagacca

SEQ ID NO: 7859 - DNA, 50 bp, Artificial Sequence
  synthetic Elaeis guineensis (oil palm) single nucleotide polymorphism (SNP) in genomic region adjacent to shatterproof1 (SHELL) shell thickness gene
caagcccccactcacgtgccctgcracaaagaccatgcatcacccgatgg

SEQ ID NO: 7860 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgcgacaaagaccatgcatcacccratggaccgcatgaagaccgcacgtg

SEQ ID NO: 7861 - DNA, 50 bp, Artificial Sequence
  synthetic Elaeis guineensis (oil palm) single nucleotide polymorphism (SNP) in genomic region adjacent to shatterproof1 (SHELL) shell thickness gene
catgcggcggtccatgcatctcgtrcatcttaggccatgcctatgggccg

SEQ ID NO: 7862 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctatgggccgcgcttgcaggcctamgtgcctgcgggtcatgctcctgtgg

SEQ ID NO: 7863 - DNA, 50 bp, Artificial Sequence
  synthetic Elaeis guineensis (oil palm) single nucleotide polymorphism (SNP) in genomic region adjacent to shatterproof1 (SHELL) shell thickness gene
agttttactgctgtagatcgaattygagataccaaaacccaatattgata

SEQ ID NO: 7864 - DNA, 50 bp, Artificial Sequence
  synthetic Elaeis guineensis (oil palm) single nucleotide polymorphism (SNP) in genomic region adjacent to shatterproof1 (SHELL) shell thickness gene
taaatcccattgtcaggagtttgtyaactttctcctcaattacttattgt

SEQ ID NO: 7865 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcctcaattacttattgtcattctrgggtgaagcttcttttcttttatca

SEQ ID NO: 7866 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttcaacttatgaacaatgatatcgraaggtacatctggcatgtctgatgc

SEQ ID NO: 7867 - DNA, 50 bp, Artificial Sequence
  synthetic Elaeis guineensis (oil palm) single nucleotide polymorphism (SNP) in genomic region adjacent to shatterproof1 (SHELL) shell thickness gene
taaggttcggtgtcaattatgctcyaagctaaatggttctgctcgaatca

SEQ ID NO: 7868 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttattatcaccaaaaaggattgamaagccagtatttgatcttctcatac

SEQ ID NO: 7869 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttattatcaccaaaaaggattgacragccagtatttgatcttctcatact

SEQ ID NO: 7870 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcgatcaatagacagtttcattctwtgaaaactattgtaaaacaacacat

SEQ ID NO: 7871 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaggatttcttttctgctcaagtcrttcaaggatcctcctaacctcactt

SEQ ID NO: 7872 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggtcagcataattttttgaaaaaawtttatcgagggagaagatgtggtac

SEQ ID NO: 7873 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctcaagcttcgacgtgaggataatygaggtgtaaaagtgggagcagagta

SEQ ID NO: 7874 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttattgctctgccacctattgaggycattgtacggcatagttagagtttg

SEQ ID NO: 7875 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaaccagggcatccaatggtagtgkattctgttgggaatagtgtttcaaa

SEQ ID NO: 7876 - DNA, 50 bp, Artificial Sequence
  synthetic Elaeis guineensis (oil palm) single nucleotide polymorphism (SNP) in genomic region adjacent to shatterproof1 (SHELL) shell thickness gene
catccaatggtagtgtattctgttrggaatagtgtttcaaagccaatcgt

SEQ ID NO: 7877 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttataaattaataaaaattattttrgtatttttcatcataaaatatttca

SEQ ID NO: 7878 - DNA, 50 bp, Artificial Sequence
  synthetic Elaeis guineensis (oil palm) single nucleotide polymorphism (SNP) in genomic region adjacent to shatterproof1 (SHELL) shell thickness gene
gatgacaatatttatcaagcatagrtcattgtgtaccatataggttggtt

SEQ ID NO: 7879 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttatcaagcataggtcattgtgtrccatataggttggttgtcctcttaa

SEQ ID NO: 7880 - DNA, 50 bp, Artificial Sequence
  synthetic Elaeis guineensis (oil palm) single nucleotide polymorphism (SNP) in genomic region adjacent to shatterproof1 (SHELL) shell thickness gene
taaccaatgagtgtggagacactgrtatggcatacaggtgagatgtaagg

SEQ ID NO: 7881 - DNA, 50 bp, Artificial Sequence
  synthetic Elaeis guineensis (oil palm) single nucleotide polymorphism (SNP) in genomic region adjacent to shatterproof1 (SHELL) shell thickness gene
gagatgtaagggtacatctgcactraacgtgaccgactccagagctattt

SEQ ID NO: 7882 - DNA, 50 bp, Artificial Sequence
  synthetic Elaeis guineensis (oil palm) single nucleotide polymorphism (SNP) in genomic region adjacent to shatterproof1 (SHELL) shell thickness gene
gggtacatctgcactaaacgtgacygactccagagctatttctgctgtca

SEQ ID NO: 7883 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctccagagctatttctgctgtcaaratttgctctgatggaatatgggtat

SEQ ID NO: 7884 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtgtcaagatgggattgaccactcyagtttaagagctgtgtacagtcata

SEQ ID NO: 7885 - DNA, 50 bp, Artificial Sequence
  synthetic Elaeis guineensis (oil palm) single nucleotide polymorphism (SNP) in genomic region adjacent to shatterproof1 (SHELL) shell thickness gene
gatgggattgaccactctagtttargagctgtgtacagtcatattttaat

SEQ ID NO: 7886 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgtgtacagtcatattttaatttakcaaaaccttggtcaggatagtcttt

SEQ ID NO: 7887 - DNA, 50 bp, Artificial Sequence
  synthetic Elaeis guineensis (oil palm) single nucleotide polymorphism (SNP) in genomic region adjacent to shatterproof1 (SHELL) shell thickness gene
agtcatattttaatttagcaaaacyttggtcaggatagtctttgcgagga

SEQ ID NO: 7888 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaccttggtcaggatagtctttgygaggagtcacaggactgtttgagtt

SEQ ID NO: 7889 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcacaggactgtttgagttgagcaygattcggatgatctaatcagggttg

SEQ ID NO: 7890 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggacgatcagcagaggtcagacatrctgtgtagctatattatgatgatca

SEQ ID NO: 7891 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatattatgatgatcagactctccygacggtgatcagattgcggcgatct

SEQ ID NO: 7892 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctcctgacggtgatcagattgcggygatctactacccgcacaaaggtatt

SEQ ID NO: 7893 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtattgtgttctgaacacattacartaaagtgtttactgttcaaattcga

SEQ ID NO: 7894 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcatgctatatatcatatttagatyctaatgtaggataaatttttattaa

SEQ ID NO: 7895 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttagattctaatgtaggataaattyttattaattaattagattaattaat

SEQ ID NO: 7896 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttaattagattaattaataattttyactgtaaaatagtgattttgaaaaa

SEQ ID NO: 7897 - DNA, 50 bp, Artificial Sequence
  synthetic Elaeis guineensis (oil palm) single nucleotide polymorphism (SNP) in genomic region adjacent to shatterproof1 (SHELL) shell thickness gene
attaccattttacccctgcactgawtttccccacaaattcatcgtaatag

SEQ ID NO: 7898 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgagagatggtggaattatgtactmtcgtctgtaccatgctctctttcct

SEQ ID NO: 7899 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgcggttgaggttggtgccaatttkaggccgacacatccaaagagaacct

SEQ ID NO: 7900 - DNA, 50 bp, Artificial Sequence
  synthetic Elaeis guineensis (oil palm) single nucleotide polymorphism (SNP) in genomic region adjacent to shatterproof1 (SHELL) shell thickness gene
gattgttaaggtagaaaatctttcwactaatctgcaaatcaaaattgtta

SEQ ID NO: 7901 - DNA, 50 bp, Artificial Sequence
  synthetic Elaeis guineensis (oil palm) single nucleotide polymorphism (SNP) in genomic region adjacent to shatterproof1 (SHELL) shell thickness gene
atcttgatttttcagctctcttcarggttcgagatagtcctgctgagcca

SEQ ID NO: 7902 - DNA, 50 bp, Artificial Sequence
  synthetic Elaeis guineensis (oil palm) single nucleotide polymorphism (SNP) in genomic region adjacent to shatterproof1 (SHELL) shell thickness gene
agaaaagaaaggttgcttcatacgrtagattgcctccgtaacaagtaggc

SEQ ID NO: 7903 - DNA, 50 bp, Artificial Sequence
  synthetic Elaeis guineensis (oil palm) single nucleotide polymorphism (SNP) in genomic region adjacent to shatterproof1 (SHELL) shell thickness gene
atttatttttatttttatttttttrtgcgttagaaatcattgcattagtg

SEQ ID NO: 7904 - DNA, 50 bp, Artificial Sequence
  synthetic Elaeis guineensis (oil palm) single nucleotide polymorphism (SNP) in genomic region adjacent to shatterproof1 (SHELL) shell thickness gene
gatcctagatccaaacagaatcccraatagcttctatccaaaaactgagt

SEQ ID NO: 7905 - DNA, 50 bp, Artificial Sequence
  synthetic Elaeis guineensis (oil palm) single nucleotide polymorphism (SNP) in genomic region adjacent to shatterproof1 (SHELL) shell thickness gene
gagtcggctcatctgaaactgagtyagttcaaactaaaactgagtcgact

SEQ ID NO: 7906 - DNA, 50 bp, Artificial Sequence
  synthetic Elaeis guineensis (oil palm) single nucleotide polymorphism (SNP) in genomic region adjacent to shatterproof1 (SHELL) shell thickness gene
accttgatgctcctaagcccttgtraactcaactttattcttcagaccta

SEQ ID NO: 7907 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagcctcttcaaccacaatgcttcyttagaagcatctgtgatacctatgt

SEQ ID NO: 7908 - DNA, 50 bp, Artificial Sequence
  synthetic Elaeis guineensis (oil palm) single nucleotide polymorphism (SNP) in genomic region adjacent to shatterproof1 (SHELL) shell thickness gene
aggtccatcttgctatccaaaaatyagaccaaaccttcgagtttcctgaa

SEQ ID NO: 7909 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaccttcgagtttcctgaagatacmgcaaaattcacttcaatgcctgccg

SEQ ID NO: 7910 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctgctgctttgaaagagacatatarcttgtcaatggtgttccaaccagtt

SEQ ID NO: 7911 - DNA, 50 bp, Artificial Sequence
  synthetic Elaeis guineensis (oil palm) single nucleotide polymorphism (SNP) in genomic region adjacent to shatterproof1 (SHELL) shell thickness gene
tagcttgtcaatggtgttccaaccrgtttggccttcttcatcccaaacct

SEQ ID NO: 7912 - DNA, 50 bp, Artificial Sequence
  synthetic Elaeis guineensis (oil palm) single nucleotide polymorphism (SNP) in genomic region adjacent to shatterproof1 (SHELL) shell thickness gene
actgcatctgcacttcttttggcawtgagcatatcgtccacatgcagaag

SEQ ID NO: 7913 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggcattgagcatatcgtccacatgyagaagcaagtataatgcatcatctt

SEQ ID NO: 7914 - DNA, 50 bp, Artificial Sequence
  synthetic Elaeis guineensis (oil palm) single nucleotide polymorphism (SNP) in genomic region adjacent to shatterproof1 (SHELL) shell thickness gene
gctccaactccatatcatgctaagmtacaagcgacagcaacatccggatt

SEQ ID NO: 7915 - DNA, 50 bp, Artificial Sequence
  synthetic Elaeis guineensis (oil palm) single nucleotide polymorphism (SNP) in genomic region adjacent to shatterproof1 (SHELL) shell thickness gene
atctaactccatcttactctgaagrtgcctccttccatgtgaacacccac

SEQ ID NO: 7916 - DNA, 50 bp, Artificial Sequence
  synthetic Elaeis guineensis (oil palm) single nucleotide polymorphism (SNP) in genomic region adjacent to shatterproof1 (SHELL) shell thickness gene
tccagtgactccatctcttctctcrtggcctgtatccatgactcccgatc

SEQ ID NO: 7917 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccatacctaagcgatctgtaaattrtacgttggagcttgtgcaatgccac

SEQ ID NO: 7918 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatcctacaatagataccctttgamtctctatggatacctgatgaatgtc

SEQ ID NO: 7919 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaatgtcatcttctgagactttggrtccaacttgcttcttttcagttgcc

SEQ ID NO: 7920 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcactgtgtaatgatgtttgatacyattctcctcacagtaccttttgaac

SEQ ID NO: 7921 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttttgaactctagacttgtgtattytcctccattatcagacctcaagcat

SEQ ID NO: 7922 - DNA, 50 bp, Artificial Sequence
  synthetic Elaeis guineensis (oil palm) single nucleotide polymorphism (SNP) in genomic region adjacent to shatterproof1 (SHELL) shell thickness gene
atacatcagctgctcctcctgtacygctacaagcacttccctactatcat

SEQ ID NO: 7923 - DNA, 50 bp, Artificial Sequence
  synthetic Elaeis guineensis (oil palm) single nucleotide polymorphism (SNP) in genomic region adjacent to shatterproof1 (SHELL) shell thickness gene
gctcctcctgtaccgctacaagcayttccctactatcattcaccactgag

SEQ ID NO: 7924 - DNA, 50 bp, Artificial Sequence
  synthetic Elaeis guineensis (oil palm) single nucleotide polymorphism (SNP) in genomic region adjacent to shatterproof1 (SHELL) shell thickness gene
acataatatcacactctgtggatcyatctgatacaaccagcagatcttcc

SEQ ID NO: 7925 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctactcccagatgccgtatcatcayttttgctggcctttcccttctttga

SEQ ID NO: 7926 - DNA, 50 bp, Artificial Sequence
  synthetic Elaeis guineensis (oil palm) single nucleotide polymorphism (SNP) in genomic region adjacent to shatterproof1 (SHELL) shell thickness gene
agaattttctttgcaaatctttttycgttgcttattagacttgagcactc

SEQ ID NO: 7927 - DNA, 50 bp, Artificial Sequence
  synthetic Elaeis guineensis (oil palm) single nucleotide polymorphism (SNP) in genomic region adjacent to shatterproof1 (SHELL) shell thickness gene
gatcttttgctgaaccaccaaattytttaccctttgctgtcataggataa

SEQ ID NO: 7928 - DNA, 50 bp, Artificial Sequence
  synthetic Elaeis guineensis (oil palm) single nucleotide polymorphism (SNP) in genomic region adjacent to shatterproof1 (SHELL) shell thickness gene
cctatgtcttgccatgcattcatcycttgaacttaattctagcccaaaca

SEQ ID NO: 7929 - DNA, 50 bp, Artificial Sequence
  synthetic Elaeis guineensis (oil palm) single nucleotide polymorphism (SNP) in genomic region adjacent to shatterproof1 (SHELL) shell thickness gene
atgctaagactgagttgactcaccygagattgagttgactcacctacatg

SEQ ID NO: 7930 - DNA, 50 bp, Artificial Sequence
  synthetic Elaeis guineensis (oil palm) single nucleotide polymorphism (SNP) in genomic region adjacent to shatterproof1 (SHELL) shell thickness gene
gattaagcagaaacattctatcctkactgattcttctgttggttttctcc

SEQ ID NO: 7931 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttggttttctcctttgacctcttgrtttcttctcatgtgttttcaaggct

SEQ ID NO: 7932 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccagactcaatcttatagaaaagtrgatcggatctacggccaagactttc

SEQ ID NO: 7933 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgctcatactagtcttaaatcacartttaaaggtttaaataggtttgaat

SEQ ID NO: 7934 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtttgaatcctaatggcatacctgrtttgggtcgtgttggatccaaattc

SEQ ID NO: 7935 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaattggatggattggatcagctargatcctaagtcaatccaatccattt

SEQ ID NO: 7936 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctatgccttcccgattagcgccctmtgttcgctgcctgcaatctatgaat

SEQ ID NO: 7937 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccgctcctggtgcacaaaaatttcrcttggaggagaactagagttggtgt

SEQ ID NO: 7938 - DNA, 50 bp, Artificial Sequence
  synthetic Elaeis guineensis (oil palm) single nucleotide polymorphism (SNP) in genomic region adjacent to shatterproof1 (SHELL) shell thickness gene
taactcccacgcccttgatgccttycatgccatcacccacattaagggct

SEQ ID NO: 7939 - DNA, 50 bp, Artificial Sequence
  synthetic Elaeis guineensis (oil palm) single nucleotide polymorphism (SNP) in genomic region adjacent to shatterproof1 (SHELL) shell thickness gene
gctagtccgagaccgttcaaccccycaaacccctgcaccaacaaccacaa

SEQ ID NO: 7940 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccacaacagtgagcatcgcggttcsgacctccatccaaccaagaatttga

SEQ ID NO: 7941 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcactgcaagatcctcaatgtcttycttctcgtcgccaccattgatgccc

SEQ ID NO: 7942 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggtagcccaaccgtttcctaggcawtaagatgcaacccccttctatccga

SEQ ID NO: 7943 - DNA, 50 bp, Artificial Sequence
  synthetic Elaeis guineensis (oil palm) single nucleotide polymorphism (SNP) in genomic region adjacent to shatterproof1 (SHELL) shell thickness gene
atcaacatatcaaataaaaaaataraaaggtaacgaaaatttttgacgag

SEQ ID NO: 7944 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaaaataaaaaggtaacgaaaatytttgacgagaccttctgatcggagt

SEQ ID NO: 7945 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttgacattatgtaatcatggaatgracggttatacccattattgatcatg

SEQ ID NO: 7946 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctgcactgacagtttttgatatamtgactctacgttggtagtctgagtg

SEQ ID NO: 7947 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggatggagttgtcacgtgctatctygagctctgatttaactgtaaacatt

SEQ ID NO: 7948 - DNA, 50 bp, Artificial Sequence
  synthetic Elaeis guineensis (oil palm) single nucleotide polymorphism (SNP) in genomic region adjacent to shatterproof1 (SHELL) shell thickness gene
atcttgagctctgatttaactgtaracattaatgatttcttcgaaaaatg

SEQ ID NO: 7949 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctggcggtaggtgcgtcaaaccatycgatcgatggttgattttgatgcag

SEQ ID NO: 7950 - DNA, 50 bp, Artificial Sequence
  synthetic Elaeis guineensis (oil palm) single nucleotide polymorphism (SNP) in genomic region adjacent to shatterproof1 (SHELL) shell thickness gene
atatatataatatcactttcatttraattttttatttttgtatttgtcat

SEQ ID NO: 7951 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgaagtcctctttgtatttccacgrtcttccaaatcatcccctagttccg

SEQ ID NO: 7952 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtatttccacggtcttccaaatcaycccctagttccggggcatgtttttt

SEQ ID NO: 7953 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtcttccaaatcatcccctagttcyggggcatgttttttttctttctttt

SEQ ID NO: 7954 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcctcgagatagtcaatcgaaaaayccgattgacgattctctttcggatc

SEQ ID NO: 7955 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaacccgattgacgattctctttcrgatccggatatgaaagtttcttcct

SEQ ID NO: 7956 - DNA, 50 bp, Artificial Sequence
  synthetic Elaeis guineensis (oil palm) single nucleotide polymorphism (SNP) in genomic region adjacent to shatterproof1 (SHELL) shell thickness gene
cctctgagtcaaatagcaatttatrtagaggaccttcaggctggtcttca

SEQ ID NO: 7957 - DNA, 50 bp, Artificial Sequence
  synthetic Elaeis guineensis (oil palm) single nucleotide polymorphism (SNP) in genomic region adjacent to shatterproof1 (SHELL) shell thickness gene
accttcaggctggtcttcatttttygattccgaagtttatccaaaatctc

SEQ ID NO: 7958 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttcgtctccatccaaaaaccaaggrttggtggttcttcaacttaagaaag

SEQ ID NO: 7959 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaataaatcccaacgaacatagtcrgatcgatgttatcaatcgagagaac

SEQ ID NO: 7960 - DNA, 50 bp, Artificial Sequence
  synthetic Elaeis guineensis (oil palm) single nucleotide polymorphism (SNP) in genomic region adjacent to shatterproof1 (SHELL) shell thickness gene
actgatggagcaatctctctataaygctggacttagtctgatgacttctc

SEQ ID NO: 7961 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcgatgtttgccaacatgttgctamgaagaaagcagtgatcgatgctgga

SEQ ID NO: 7962 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatcacactgtcagctccaacagtrcttcctccaatcgatgtaccatcga

SEQ ID NO: 7963 - DNA, 50 bp, Artificial Sequence
  synthetic Elaeis guineensis (oil palm) single nucleotide polymorphism (SNP) in genomic region adjacent to shatterproof1 (SHELL) shell thickness gene
agtgcttcctccaatcgatgtaccrtcgatcaaagtgaaattaaccagag

SEQ ID NO: 7964 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttcaactgggccgatgctgtttcargtgccattaacttctgacttcatga

SEQ ID NO: 7965 - DNA, 50 bp, Artificial Sequence
  synthetic Elaeis guineensis (oil palm) single nucleotide polymorphism (SNP) in genomic region adjacent to shatterproof1 (SHELL) shell thickness gene
agctgtttctgtcgatgatggatcrtcaacaagcttcaccgtgctttttg

SEQ ID NO: 7966 - DNA, 50 bp, Artificial Sequence
  synthetic Elaeis guineensis (oil palm) single nucleotide polymorphism (SNP) in genomic region adjacent to shatterproof1 (SHELL) shell thickness gene
gacgtaagttgatgatacttttctratactcttctattttttgtttttgt

SEQ ID NO: 7967 - DNA, 50 bp, Artificial Sequence
  synthetic Elaeis guineensis (oil palm) single nucleotide polymorphism (SNP) in genomic region adjacent to shatterproof1 (SHELL) shell thickness gene
catcgaaaaattatcgagtttcatygagcatggatggataaaactacagc

SEQ ID NO: 7968 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagaacaaaaagcactcaatcaaayggcttcgaagggagtgtgatggctg

SEQ ID NO: 7969 - DNA, 50 bp, Artificial Sequence
  synthetic Elaeis guineensis (oil palm) single nucleotide polymorphism (SNP) in genomic region adjacent to shatterproof1 (SHELL) shell thickness gene
agcagcatcgttgcccttggttcgrggaagagattgccgaggagattgca

SEQ ID NO: 7970 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgcccttggttcggggaagagattrccgaggagattgcaccaactgaaga

SEQ ID NO: 7971 - DNA, 50 bp, Artificial Sequence
  synthetic Elaeis guineensis (oil palm) single nucleotide polymorphism (SNP) in genomic region adjacent to shatterproof1 (SHELL) shell thickness gene
agattgctaattatcaatcggtgtrttgaatgtcgatcagtagtcatagt

SEQ ID NO: 7972 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctagtcggatatcacctgacttagmttttaaataattttttttaaaatat

SEQ ID NO: 7973 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttgatctaaagattttgaaacttytgtctttcttaagactaggtctctt

SEQ ID NO: 7974 - DNA, 50 bp, Artificial Sequence
  synthetic Elaeis guineensis (oil palm) single nucleotide polymorphism (SNP) in genomic region adjacent to shatterproof1 (SHELL) shell thickness gene
tggctcattatattggtcgactctyactgacagcaatccaatctcgagca

SEQ ID NO: 7975 - DNA, 50 bp, Artificial Sequence
  synthetic Elaeis guineensis (oil palm) single nucleotide polymorphism (SNP) in genomic region adjacent to shatterproof1 (SHELL) shell thickness gene
aattaaatggcaattctcctattgstatatgtagagttgtccgatatact

SEQ ID NO: 7976 - DNA, 50 bp, Artificial Sequence
  synthetic Elaeis guineensis (oil palm) single nucleotide polymorphism (SNP) in genomic region adjacent to shatterproof1 (SHELL) shell thickness gene
gccttaagaccatgtagaattattygatttgtcactttcacttcatcgtt

SEQ ID NO: 7977 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcgttagattatggatgaccgacakaagtgagtttgtacgtaatgtgaag

SEQ ID NO: 7978 - DNA, 50 bp, Artificial Sequence
  synthetic Elaeis guineensis (oil palm) single nucleotide polymorphism (SNP) in genomic region adjacent to shatterproof1 (SHELL) shell thickness gene
cattatcggtgatgatggtgtgtgrtaaatcgaatctacatatgattgat

SEQ ID NO: 7979 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctttcatcttattttcagtgatttrtgtcaaaggttcggcttccatccat

SEQ ID NO: 7980 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctgactggtcggttgatgttgtatrttggcatacttctgacatgatttat

SEQ ID NO: 7981 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttgatgttgtatgttggcatacttytgacatgatttatattttccaaaaa

SEQ ID NO: 7982 - DNA, 50 bp, Artificial Sequence
  synthetic Elaeis guineensis (oil palm) single nucleotide polymorphism (SNP) in genomic region adjacent to shatterproof1 (SHELL) shell thickness gene
acttctgacatgatttatattttcmaaaaaatttagctgcatctttcttt

SEQ ID NO: 7983 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggtgggccaataatatccttatcgyaaaactttataagccaatgatttat

SEQ ID NO: 7984 - DNA, 50 bp, Artificial Sequence
  synthetic Elaeis guineensis (oil palm) single nucleotide polymorphism (SNP) in genomic region adjacent to shatterproof1 (SHELL) shell thickness gene
atgatttatcctcctaagtaatttycacaaattccttcgtaaacttttcg

SEQ ID NO: 7985 - DNA, 50 bp, Artificial Sequence
  synthetic Elaeis guineensis (oil palm) single nucleotide polymorphism (SNP) in genomic region adjacent to shatterproof1 (SHELL) shell thickness gene
atttatcctcctaagtaatttccayaaattccttcgtaaacttttcggag

SEQ ID NO: 7986 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctttagtaagggaagagagaatgaycttttataaagttattcattcatca

SEQ ID NO: 7987 - DNA, 50 bp, Artificial Sequence
  synthetic Elaeis guineensis (oil palm) single nucleotide polymorphism (SNP) in genomic region adjacent to shatterproof1 (SHELL) shell thickness gene
attatgaggccgtccaccttagtcrtttgatctctgaaagatctgtaggt

SEQ ID NO: 7988 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttggttcatcattaatttgtagcaytttatcaattttatcaatactcgat

SEQ ID NO: 7989 - DNA, 50 bp, Artificial Sequence
  synthetic Elaeis guineensis (oil palm) single nucleotide polymorphism (SNP) in genomic region adjacent to shatterproof1 (SHELL) shell thickness gene
gatatttaatgaacgtacggtcgarcgagctgaatgaggaagttgcgagt

SEQ ID NO: 7990 - DNA, 50 bp, Artificial Sequence
  synthetic Elaeis guineensis (oil palm) single nucleotide polymorphism (SNP) in genomic region adjacent to shatterproof1 (SHELL) shell thickness gene
agctgaatgaggaagttgcgagtcraaaaaatgcattagcttgagcattc

SEQ ID NO: 7991 - DNA, 50 bp, Artificial Sequence
  synthetic Elaeis guineensis (oil palm) single nucleotide polymorphism (SNP) in genomic region adjacent to shatterproof1 (SHELL) shell thickness gene
attagcttgagcattctctattttygagatgtgagagatctcgaagtatt

SEQ ID NO: 7992 - DNA, 50 bp, Artificial Sequence
  synthetic Elaeis guineensis (oil palm) single nucleotide polymorphism (SNP) in genomic region adjacent to shatterproof1 (SHELL) shell thickness gene
cttttactttctgaagatacatcayaatagaatttcgggctccaaattca

SEQ ID NO: 7993 - DNA, 50 bp, Artificial Sequence
  synthetic Elaeis guineensis (oil palm) single nucleotide polymorphism (SNP) in genomic region adjacent to shatterproof1 (SHELL) shell thickness gene
tactttctgaagatacatcataatrgaatttcgggctccaaattcattct

SEQ ID NO: 7994 - DNA, 50 bp, Artificial Sequence
  synthetic Elaeis guineensis (oil palm) single nucleotide polymorphism (SNP) in genomic region adjacent to shatterproof1 (SHELL) shell thickness gene
taatataaaattgctctcaatggtygatctgttaagacaactattggatg

SEQ ID NO: 7995 - DNA, 50 bp, Artificial Sequence
  synthetic Elaeis guineensis (oil palm) single nucleotide polymorphism (SNP) in genomic region adjacent to shatterproof1 (SHELL) shell thickness gene
agacctttatgttacatttgatttrtgtcttgaacagtctgttgactagc

SEQ ID NO: 7996 - DNA, 50 bp, Artificial Sequence
  synthetic Elaeis guineensis (oil palm) single nucleotide polymorphism (SNP) in genomic region adjacent to shatterproof1 (SHELL) shell thickness gene
taaaggcagtatgcttctcatcttyaggtgtcattcgaatttagttgtag

SEQ ID NO: 7997 - DNA, 50 bp, Artificial Sequence
  synthetic Elaeis guineensis (oil palm) single nucleotide polymorphism (SNP) in genomic region adjacent to shatterproof1 (SHELL) shell thickness gene
atcgatttttgataaagaaaagatrtttttcagacaaacttcatttaaat

SEQ ID NO: 7998 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagaaaagatgtttttcagacaaayttcatttaaattggtatagttgatg

SEQ ID NO: 7999 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttactatattagcaagctaatctgratagttagcttctcttatgaagtca

SEQ ID NO: 8000 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcaagtaaaaatgttggcatttgcycttagtaggttcactagttattttc

SEQ ID NO: 8001 - DNA, 50 bp, Artificial Sequence
  synthetic Elaeis guineensis (oil palm) single nucleotide polymorphism (SNP) in genomic region adjacent to shatterproof1 (SHELL) shell thickness gene
atggtatgttgatactattgctctyaagacattaagtcctgatcatccaa

SEQ ID NO: 8002 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgtggttgaggttgtcggtcagtgrgaagttgaatcaggcagtcttgtta

SEQ ID NO: 8003 - DNA, 50 bp, Artificial Sequence
  synthetic Elaeis guineensis (oil palm) single nucleotide polymorphism (SNP) in genomic region adjacent to shatterproof1 (SHELL) shell thickness gene
atcgtgaccgtgatcatgataaaaycgacaatacttttttttgtcgcagc

SEQ ID NO: 8004 - DNA, 50 bp, Artificial Sequence
  synthetic Elaeis guineensis (oil palm) single nucleotide polymorphism (SNP) in genomic region adjacent to shatterproof1 (SHELL) shell thickness gene
tacttttttttgtcgcagctcctcrgtggtgctttcatcgatgggggatg

SEQ ID NO: 8005 - DNA, 50 bp, Artificial Sequence
  synthetic Elaeis guineensis (oil palm) single nucleotide polymorphism (SNP) in genomic region adjacent to shatterproof1 (SHELL) shell thickness gene
acttttttttgtcgcagctcctcgrtggtgctttcatcgatgggggatga

SEQ ID NO: 8006 - DNA, 50 bp, Artificial Sequence
  synthetic Elaeis guineensis (oil palm) single nucleotide polymorphism (SNP) in genomic region adjacent to shatterproof1 (SHELL) shell thickness gene
tccctcaatctctattaggatctayacatgaagagcaaaaagaaaaatat

SEQ ID NO: 8007 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggagtcatacctgctatcataattrttcgatcttggactccatcgatgga

SEQ ID NO: 8008 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtcatacctgctatcataattgttygatcttggactccatcgatggagtg

SEQ ID NO: 8009 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttgttgatcgatttggttcgatcgragcttcatcttttttttgcttcttt

SEQ ID NO: 8010 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttttgatatttttttttgcttgacrttggtcagaagtatcctcattcatg

SEQ ID NO: 8011 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggaccacgaacaaatgtttgagctrctcaaaaaaatttatgctccccggt

SEQ ID NO: 8012 - DNA, 50 bp, Artificial Sequence
  synthetic Elaeis guineensis (oil palm) single nucleotide polymorphism (SNP) in genomic region adjacent to shatterproof1 (SHELL) shell thickness gene
gctcaaaaaaatttatgctccccgrttggagcccagaataccagactcga

SEQ ID NO: 8013 - DNA, 50 bp, Artificial Sequence
  synthetic Elaeis guineensis (oil palm) single nucleotide polymorphism (SNP) in genomic region adjacent to shatterproof1 (SHELL) shell thickness gene
aggacttccagccttccacttggartcggaggagttgacaatcgatcttt

SEQ ID NO: 8014 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccacttggagtcggaggagttgacratcgatctttttaaatttgtgctcg

SEQ ID NO: 8015 - DNA, 50 bp, Artificial Sequence
  synthetic Elaeis guineensis (oil palm) single nucleotide polymorphism (SNP) in genomic region adjacent to shatterproof1 (SHELL) shell thickness gene
gttgttgctggaaaaattcaggggyagtcacctgaagaacttaaggattg

SEQ ID NO: 8016 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctgtattaaagtagtaatttgaacrtctgcagtgactacaggatgtgaag

SEQ ID NO: 8017 - DNA, 50 bp, Artificial Sequence
  synthetic Elaeis guineensis (oil palm) single nucleotide polymorphism (SNP) in genomic region adjacent to shatterproof1 (SHELL) shell thickness gene
cctatggagttattttgagctctartttttaccataattttttgtaagcc

SEQ ID NO: 8018 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaattatgtccgacaaagatctttygatgcttaagttagtgaagagtagt

SEQ ID NO: 8019 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttagcctagaagtatcttaccaatrctgttcatttacctcctttttatag

SEQ ID NO: 8020 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaagtcggttaagtcaccatggttkaattgtatttgccaggaaagttgag

SEQ ID NO: 8021 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgccaggaaagttgagaatagctgrctgttgatcggcttactgattgata

SEQ ID NO: 8022 - DNA, 50 bp, Artificial Sequence
  synthetic Elaeis guineensis (oil palm) single nucleotide polymorphism (SNP) in genomic region adjacent to shatterproof1 (SHELL) shell thickness gene
atgtagctttgatggtttatcatcmataatcgatagatatccgatcgacc

SEQ ID NO: 8023 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtcataacaataaataaaaaaagcyagtgaatcttgtcataggcctcctc

SEQ ID NO: 8024 - DNA, 50 bp, Artificial Sequence
  synthetic Elaeis guineensis (oil palm) single nucleotide polymorphism (SNP) in genomic region adjacent to shatterproof1 (SHELL) shell thickness gene
agaaagaggtactttgtgcagtgamtgcaatatttcataggcaaaaaagg

SEQ ID NO: 8025 - DNA, 50 bp, Artificial Sequence
  synthetic Elaeis guineensis (oil palm) single nucleotide polymorphism (SNP) in genomic region adjacent to shatterproof1 (SHELL) shell thickness gene
gacaatcttataaggagaattgcamaagccaattggtctataatctgtag

SEQ ID NO: 8026 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttgaaaatgtcgcataaggacttrctggattaggtgttgatcttccacc

SEQ ID NO: 8027 - DNA, 50 bp, Artificial Sequence
  synthetic Elaeis guineensis (oil palm) single nucleotide polymorphism (SNP) in genomic region adjacent to shatterproof1 (SHELL) shell thickness gene
gatcttccaccttttctccatcctyattttttatagaatgaattttatta

SEQ ID NO: 8028 - DNA, 50 bp, Artificial Sequence
  synthetic Elaeis guineensis (oil palm) single nucleotide polymorphism (SNP) in genomic region adjacent to shatterproof1 (SHELL) shell thickness gene
cctattgttccaccaagtataattrggccctcaatagcctacattaatca

SEQ ID NO: 8029 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctgttgggaatagtgtcccaaagycaattgttagcctgttgacagttgt

SEQ ID NO: 8030 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgggaatagtgtcccaaagccaatygttagcctgttgacagttgtgctcc

SEQ ID NO: 8031 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaatagtgtcccaaagccaattgtyagcctgttgacagttgtgctccttt

SEQ ID NO: 8032 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatgtacagtcgtgtttcaatttakcaaaatcttggccagggtagtccta

SEQ ID NO: 8033 - DNA, 50 bp, Artificial Sequence
  synthetic Elaeis guineensis (oil palm) single nucleotide polymorphism (SNP) in genomic region adjacent to shatterproof1 (SHELL) shell thickness gene
cagtcgtgtttcaatttatcaaaaycttggccagggtagtcctagtgaag

SEQ ID NO: 8034 - DNA, 50 bp, Artificial Sequence
  synthetic Elaeis guineensis (oil palm) single nucleotide polymorphism (SNP) in genomic region adjacent to shatterproof1 (SHELL) shell thickness gene
cagggtagtcctagtgaagagtcayaggactaattgagttgagcacgatt

SEQ ID NO: 8035 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgagttgagcacgattcggatgatmtcatcagggttgacagtttaaccct

SEQ ID NO: 8036 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttcctaaacacaggggtcaaaaggratgaattatacggtaaccatattca

SEQ ID NO: 8037 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatacggtaaccatattcacgtagrttctgaatgttgcgattgcgactat

SEQ ID NO: 8038 - DNA, 50 bp, Artificial Sequence
  synthetic Elaeis guineensis (oil palm) single nucleotide polymorphism (SNP) in genomic region adjacent to shatterproof1 (SHELL) shell thickness gene
cgtagattctgaatgttgcgattgygactattcgatctatccgatcgtcg

SEQ ID NO: 8039 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcctttctgatctgatggctgattwtgagtcttatgtatctgggactcta

SEQ ID NO: 8040 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctgggactctatgattgagaattargattctttgatcatgagttccacac

SEQ ID NO: 8041 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctatgattgagaattaagattctytgatcatgagttccacacattttgg

SEQ ID NO: 8042 - DNA, 50 bp, Artificial Sequence
  synthetic Elaeis guineensis (oil palm) single nucleotide polymorphism (SNP) in genomic region adjacent to shatterproof1 (SHELL) shell thickness gene
atgagttccacacattttggatacyggggtcaaaattttgaatttcaaat

SEQ ID NO: 8043 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatttgattgagtaattatttttaratgaagtccaattgaattggattca

SEQ ID NO: 8044 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttgattgagtaattatttttaaatsaagtccaattgaattggattcagtt

SEQ ID NO: 8045 - DNA, 50 bp, Artificial Sequence
  synthetic Elaeis guineensis (oil palm) single nucleotide polymorphism (SNP) in genomic region adjacent to shatterproof1 (SHELL) shell thickness gene
gagtaattatttttaaatgaagtcyaattgaattggattcagtttggatt

SEQ ID NO: 8046 - DNA, 50 bp, Artificial Sequence
  synthetic Elaeis guineensis (oil palm) single nucleotide polymorphism (SNP) in genomic region adjacent to shatterproof1 (SHELL) shell thickness gene
aattggattcagtttggattgaccygattaggttaagtgttgatctaatc

SEQ ID NO: 8047 - DNA, 50 bp, Artificial Sequence
  synthetic Elaeis guineensis (oil palm) single nucleotide polymorphism (SNP) in genomic region adjacent to shatterproof1 (SHELL) shell thickness gene
agggggcgtgggcaatgaaagaaakaagaaataaggggcgtggggaggtt

SEQ ID NO: 8048 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcgtgggcaatgaaagaaataagarataaggggcgtggggaggttctaga

SEQ ID NO: 8049 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaataaggggcgtggggaggttctrgaaaaattttgaagtgttcaaaatt

SEQ ID NO: 8050 - DNA, 50 bp, Artificial Sequence
  synthetic Elaeis guineensis (oil palm) single nucleotide polymorphism (SNP) in genomic region adjacent to shatterproof1 (SHELL) shell thickness gene
gagagaaaaggagagagaagtgggygcagggtttttggtgtgtaccctag

SEQ ID NO: 8051 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttttggtgtgtaccctagggtttcwacttagggttcaggaagtgagattg

SEQ ID NO: 8052 - DNA, 50 bp, Artificial Sequence
  synthetic Elaeis guineensis (oil palm) single nucleotide polymorphism (SNP) in genomic region adjacent to shatterproof1 (SHELL) shell thickness gene
tggtgtgtaccctagggtttctacytagggttcaggaagtgagattggta

SEQ ID NO: 8053 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccctagggtttctacttagggttcrggaagtgagattggtatgccacgag

SEQ ID NO: 8054 - DNA, 50 bp, Artificial Sequence
  synthetic Elaeis guineensis (oil palm) single nucleotide polymorphism (SNP) in genomic region adjacent to shatterproof1 (SHELL) shell thickness gene
tccatcagcctctcaaccaaccatrcagatgatccaaagcatccgaggag

SEQ ID NO: 8055 - DNA, 50 bp, Artificial Sequence
  synthetic Elaeis guineensis (oil palm) single nucleotide polymorphism (SNP) in genomic region adjacent to shatterproof1 (SHELL) shell thickness gene
gatccaaagcatccgaggagtcagsacatatcgatcgaaggagttcgatc

SEQ ID NO: 8056 - DNA, 50 bp, Artificial Sequence
  synthetic Elaeis guineensis (oil palm) single nucleotide polymorphism (SNP) in genomic region adjacent to shatterproof1 (SHELL) shell thickness gene
caaagcatccgaggagtcaggacayatcgatcgaaggagttcgatcaaca

SEQ ID NO: 8057 - DNA, 50 bp, Artificial Sequence
  synthetic Elaeis guineensis (oil palm) single nucleotide polymorphism (SNP) in genomic region adjacent to shatterproof1 (SHELL) shell thickness gene
cgatcaacatcagccatcaaaaggrtgaaatcacgaactagcattcgtga

SEQ ID NO: 8058 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcattcgtgaggagccgatcagacrggagctttgtgtggatgatccgcag

SEQ ID NO: 8059 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaggagccgatcagacaggagcttygtgtggatgatccgcagaggccaga

SEQ ID NO: 8060 - DNA, 50 bp, Artificial Sequence
  synthetic Elaeis guineensis (oil palm) single nucleotide polymorphism (SNP) in genomic region adjacent to shatterproof1 (SHELL) shell thickness gene
gatcagacaggagctttgtgtggaygatccgcagaggccagacactagtg

SEQ ID NO: 8061 - DNA, 50 bp, Artificial Sequence
  synthetic Elaeis guineensis (oil palm) single nucleotide polymorphism (SNP) in genomic region adjacent to shatterproof1 (SHELL) shell thickness gene
acaggagctttgtgtggatgatccrcagaggccagacactagtgtggctg

SEQ ID NO: 8062 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcgactacccgcaaaaggtgatgtrttctgaacacagtacagtaaaaagt

SEQ ID NO: 8063 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttgaatttcaaatttaaatgcatrctgttgtatcatatttagatcctag

SEQ ID NO: 8064 - DNA, 50 bp, Artificial Sequence
  synthetic Elaeis guineensis (oil palm) single nucleotide polymorphism (SNP) in genomic region adjacent to shatterproof1 (SHELL) shell thickness gene
atgagattaattaataattttactrtaaaataataattatgaaaaagttt

SEQ ID NO: 8065 - DNA, 50 bp, Artificial Sequence
  synthetic Elaeis guineensis (oil palm) single nucleotide polymorphism (SNP) in genomic region adjacent to shatterproof1 (SHELL) shell thickness gene
aattaataattttactataaaatartaattatgaaaaagttttaaaaatt

SEQ ID NO: 8066 - DNA, 50 bp, Artificial Sequence
  synthetic Elaeis guineensis (oil palm) single nucleotide polymorphism (SNP) in genomic region adjacent to shatterproof1 (SHELL) shell thickness gene
taattttactataaaataataattwtgaaaaagttttaaaaattatcatt

SEQ ID NO: 8067 - DNA, 50 bp, Artificial Sequence
  synthetic Elaeis guineensis (oil palm) single nucleotide polymorphism (SNP) in genomic region adjacent to shatterproof1 (SHELL) shell thickness gene
cctattaggaaatgttaagatgcayagcagaaaaataataataacttttc

SEQ ID NO: 8068 - DNA, 50 bp, Artificial Sequence
  synthetic Elaeis guineensis (oil palm) single nucleotide polymorphism (SNP) in genomic region adjacent to shatterproof1 (SHELL) shell thickness gene
aattttttatttatgtatatagcaraaaataattttagatttaaataatt

SEQ ID NO: 8069 - DNA, 50 bp, Artificial Sequence
  synthetic Elaeis guineensis (oil palm) single nucleotide polymorphism (SNP) in genomic region adjacent to shatterproof1 (SHELL) shell thickness gene
tccatcataaatatcattgaaatcyatttcaatagattgaaacacttcca

SEQ ID NO: 8070 - DNA, 50 bp, Artificial Sequence
  synthetic Elaeis guineensis (oil palm) single nucleotide polymorphism (SNP) in genomic region adjacent to shatterproof1 (SHELL) shell thickness gene
cttggtgtgttaacgtgtgattcarttcttttatcatgagttctgataag

SEQ ID NO: 8071 - DNA, 50 bp, Artificial Sequence
  synthetic Elaeis guineensis (oil palm) single nucleotide polymorphism (SNP) in genomic region adjacent to shatterproof1 (SHELL) shell thickness gene
taagatggagatcatgaaaaactcrtcaaacctcatcatatatcatatat

SEQ ID NO: 8072 - DNA, 50 bp, Artificial Sequence
  synthetic Elaeis guineensis (oil palm) single nucleotide polymorphism (SNP) in genomic region adjacent to shatterproof1 (SHELL) shell thickness gene
cagctcaagttcaactcgtgatttytcataaaaatttctttccatcaatc

SEQ ID NO: 8073 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctcaagatgttgagaatttgagacrtacatcattagtagttaatttttaa

SEQ ID NO: 8074 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgctttcgattgaaggatcgtcacraaggatggtgatcaatccattcaaa

SEQ ID NO: 8075 - DNA, 50 bp, Artificial Sequence
  synthetic Elaeis guineensis (oil palm) single nucleotide polymorphism (SNP) in genomic region adjacent to shatterproof1 (SHELL) shell thickness gene
cgattgaaggatcgtcacgaaggayggtgatcaatccattcaaaattggt

SEQ ID NO: 8076 - DNA, 50 bp, Artificial Sequence
  synthetic Elaeis guineensis (oil palm) single nucleotide polymorphism (SNP) in genomic region adjacent to shatterproof1 (SHELL) shell thickness gene
cctctctttggggcagataagtctygagtctatggtgtagagatactaag

SEQ ID NO: 8077 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctgagcgtgatcaatacaaaaaatyacttggatgtctactcactcatcag

SEQ ID NO: 8078 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtttgactgcacattctcttagtcyctagccattcaggttcttattatat

SEQ ID NO: 8079 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttcaggttcttattatatatgttgrctattgtaggttcagattcgttatt

SEQ ID NO: 8080 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttcttattatatatgttggctattrtaggttcagattcgttatttgaagt

SEQ ID NO: 8081 - DNA, 50 bp, Artificial Sequence
  synthetic Elaeis guineensis (oil palm) single nucleotide polymorphism (SNP) in genomic region adjacent to shatterproof1 (SHELL) shell thickness gene
agaaaatctctggccagactaagtrtgaatactgaaaaagagttttcata

SEQ ID NO: 8082 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgaatactgaaaaagagttttcatragatttacaaatgaactcaagtcaa

SEQ ID NO: 8083 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttgacgagttctccatgacctccrtcaagtcgaaactcataatagagaa

SEQ ID NO: 8084 - DNA, 50 bp, Artificial Sequence
  synthetic Elaeis guineensis (oil palm) single nucleotide polymorphism (SNP) in genomic region adjacent to shatterproof1 (SHELL) shell thickness gene
atatgataactacacctaagggttyatttttttattctactagattatca

SEQ ID NO: 8085 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttaaattttaaaaattgctaatttrtaattgttataattttggtagctgc

SEQ ID NO: 8086 - DNA, 50 bp, Artificial Sequence
  synthetic Elaeis guineensis (oil palm) single nucleotide polymorphism (SNP) in genomic region adjacent to shatterproof1 (SHELL) shell thickness gene
agctttttgaattcgacttgattcrgactcaatttgaatccgattaagac

SEQ ID NO: 8087 - DNA, 50 bp, Artificial Sequence
  synthetic Elaeis guineensis (oil palm) single nucleotide polymorphism (SNP) in genomic region adjacent to shatterproof1 (SHELL) shell thickness gene
aggtcttgcgtgaacaagaagtgcracttttttaggacatcacaatcctt

SEQ ID NO: 8088 - DNA, 50 bp, Artificial Sequence
  synthetic Elaeis guineensis (oil palm) single nucleotide polymorphism (SNP) in genomic region adjacent to shatterproof1 (SHELL) shell thickness gene
cagagagaaaaagagaagaataagraattttcttctcttcatggtgatct

SEQ ID NO: 8089 - DNA, 50 bp, Artificial Sequence
  synthetic Elaeis guineensis (oil palm) single nucleotide polymorphism (SNP) in genomic region adjacent to shatterproof1 (SHELL) shell thickness gene
agatctagatccaaagttgaggagygagatctataaagtgctagcacatc

SEQ ID NO: 8090 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtgtgcagctacgattagaattcgratatccgcatatccaaggtatagag

SEQ ID NO: 8091 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccattcgatgggttctctcttatgrcgtgtaggggtatcgactgtgatat

SEQ ID NO: 8092 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttctctcttatgacgtgtaggggtrtcgactgtgatatttttcatgaaga

SEQ ID NO: 8093 - DNA, 50 bp, Artificial Sequence
  synthetic Elaeis guineensis (oil palm) single nucleotide polymorphism (SNP) in genomic region adjacent to shatterproof1 (SHELL) shell thickness gene
gacatacgatctaaaacttaatttytgtaaaattttagatccaaaatcct

SEQ ID NO: 8094 - DNA, 50 bp, Artificial Sequence
  synthetic Elaeis guineensis (oil palm) single nucleotide polymorphism (SNP) in genomic region adjacent to shatterproof1 (SHELL) shell thickness gene
aggtcagctcacttactgatgagcsaactcaattgtgcaggttaggtcac

SEQ ID NO: 8095 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggtcagctcacttactgatgagccractcaattgtgcaggttaggtcaca

SEQ ID NO: 8096 - DNA, 50 bp, Artificial Sequence
  synthetic Elaeis guineensis (oil palm) single nucleotide polymorphism (SNP) in genomic region adjacent to shatterproof1 (SHELL) shell thickness gene
cttaaacccatgtacataatgcagytaattgagaattaatatttgaaatt

SEQ ID NO: 8097 - DNA, 50 bp, Artificial Sequence
  synthetic Elaeis guineensis (oil palm) single nucleotide polymorphism (SNP) in genomic region adjacent to shatterproof1 (SHELL) shell thickness gene
catgtacataatgcagttaattgaraattaatatttgaaattataaaatc

SEQ ID NO: 8098 - DNA, 50 bp, Artificial Sequence
  synthetic Elaeis guineensis (oil palm) single nucleotide polymorphism (SNP) in genomic region adjacent to shatterproof1 (SHELL) shell thickness gene
attaatatttgaaattataaaatcwaaaattatgaatttaagatctaaat

SEQ ID NO: 8099 - DNA, 50 bp, Artificial Sequence
  synthetic Elaeis guineensis (oil palm) single nucleotide polymorphism (SNP) in genomic region adjacent to shatterproof1 (SHELL) shell thickness gene
attatgaatttaagatctaaatttyaatacataaaatatgagtttcaggt

SEQ ID NO: 8100 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccaatttggtatctaagacaagtaytagatagtgattatttaattgattc

SEQ ID NO: 8101 - DNA, 50 bp, Artificial Sequence
  synthetic Elaeis guineensis (oil palm) single nucleotide polymorphism (SNP) in genomic region adjacent to shatterproof1 (SHELL) shell thickness gene
cattggtgtttaagaaaagcaacgragaaaccttactcatctttatttgt

SEQ ID NO: 8102 - DNA, 50 bp, Artificial Sequence
  synthetic Elaeis guineensis (oil palm) single nucleotide polymorphism (SNP) in genomic region adjacent to shatterproof1 (SHELL) shell thickness gene
gagaaaccttactcatctttatttrtctgatcattttgaaagattatatt

SEQ ID NO: 8103 - DNA, 50 bp, Artificial Sequence
  synthetic Elaeis guineensis (oil palm) single nucleotide polymorphism (SNP) in genomic region adjacent to shatterproof1 (SHELL) shell thickness gene
tatattttgtattaggttacttgtrgatccgagttcacccatgccaacta

SEQ ID NO: 8104 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgtagagatgtgggtgtctttttcracgttgatcgttctcgactagttac

SEQ ID NO: 8105 - DNA, 50 bp, Artificial Sequence
  synthetic Elaeis guineensis (oil palm) single nucleotide polymorphism (SNP) in genomic region adjacent to shatterproof1 (SHELL) shell thickness gene
tagagatgtgggtgtctttttcgaygttgatcgttctcgactagttacag

SEQ ID NO: 8106 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagaaatatgccaataactgttagrtgagaccacaggacttagagatcca

SEQ ID NO: 8107 - DNA, 50 bp, Artificial Sequence
  synthetic Elaeis guineensis (oil palm) single nucleotide polymorphism (SNP) in genomic region adjacent to shatterproof1 (SHELL) shell thickness gene
aataactgttaggtgagaccacagracttagagatccagtcgctgcaaca

SEQ ID NO: 8108 - DNA, 50 bp, Artificial Sequence
  synthetic Elaeis guineensis (oil palm) single nucleotide polymorphism (SNP) in genomic region adjacent to shatterproof1 (SHELL) shell thickness gene
acaggacttagagatccagtcgctkcaacatgcttggagaagcatctgga

SEQ ID NO: 8109 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaagcatctggataaagagttgtcyacatattgatatacgtgttatcaat

SEQ ID NO: 8110 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttatcaataactgttaggtgaggtrccgtatatcgataggaccacaacat

SEQ ID NO: 8111 - DNA, 50 bp, Artificial Sequence
  synthetic Elaeis guineensis (oil palm) single nucleotide polymorphism (SNP) in genomic region adjacent to shatterproof1 (SHELL) shell thickness gene
cgtgttaggattttcttctccatcygagtgtgagagactcgaaaaattag

SEQ ID NO: 8112 - DNA, 50 bp, Artificial Sequence
  synthetic Elaeis guineensis (oil palm) single nucleotide polymorphism (SNP) in genomic region adjacent to shatterproof1 (SHELL) shell thickness gene
aaaattagtgagagcctttgtttgyttttaaagtccttagatcaaattat

SEQ ID NO: 8113 - DNA, 50 bp, Artificial Sequence
  synthetic Elaeis guineensis (oil palm) single nucleotide polymorphism (SNP) in genomic region adjacent to shatterproof1 (SHELL) shell thickness gene
agagcctttgtttgtttttaaagtycttagatcaaattattacaagtaca

SEQ ID NO: 8114 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctttactctctatgatcaatttttyagcttccaacactcaagctcgaatc

SEQ ID NO: 8115 - DNA, 50 bp, Artificial Sequence
  synthetic Elaeis guineensis (oil palm) single nucleotide polymorphism (SNP) in genomic region adjacent to shatterproof1 (SHELL) shell thickness gene
caatagttgtaagatgatcagagtygcacagtgcatgagatgcatgatgg

SEQ ID NO: 8116 - DNA, 50 bp, Artificial Sequence
  synthetic Elaeis guineensis (oil palm) single nucleotide polymorphism (SNP) in genomic region adjacent to shatterproof1 (SHELL) shell thickness gene
aataaatattataacatcttaattraattggtcgatatgctggtaactaa

SEQ ID NO: 8117 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcaaattactcaaaattgatattayaatttttttctttttcattagactc

SEQ ID NO: 8118 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatgatgcaaatattgcactgagaycgtgagtacctaatctcagtgatta

SEQ ID NO: 8119 - DNA, 50 bp, Artificial Sequence
  synthetic Elaeis guineensis (oil palm) single nucleotide polymorphism (SNP) in genomic region adjacent to shatterproof1 (SHELL) shell thickness gene
acctaatctcagtgattatcatttrgatttaattctttatcatttgcatg

SEQ ID NO: 8120 - DNA, 50 bp, Artificial Sequence
  synthetic Elaeis guineensis (oil palm) single nucleotide polymorphism (SNP) in genomic region adjacent to shatterproof1 (SHELL) shell thickness gene
gctaagtcatgtatgagaagaaatratttgccgaccgaagaaaatgggct

SEQ ID NO: 8121 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtatgagaagaaatgatttgccgaycgaagaaaatgggctttttgggctc

SEQ ID NO: 8122 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcatatctagtctacaaatcatctmtttgaggattaatgactaaactgtc

SEQ ID NO: 8123 - DNA, 50 bp, Artificial Sequence
  synthetic Elaeis guineensis (oil palm) single nucleotide polymorphism (SNP) in genomic region adjacent to shatterproof1 (SHELL) shell thickness gene
gagatacttatcttagtacacatayaatatgcatggcctatttgatgaac

SEQ ID NO: 8124 - DNA, 50 bp, Artificial Sequence
  synthetic Elaeis guineensis (oil palm) single nucleotide polymorphism (SNP) in genomic region adjacent to shatterproof1 (SHELL) shell thickness gene
agattttgaaaggttcaaagaattyaggtgtaaagtaaaaaagataaatg

SEQ ID NO: 8125 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagatactttgatcagatcgaggaygcaataccaaatggagaatttatcg

SEQ ID NO: 8126 - DNA, 50 bp, Artificial Sequence
  synthetic Elaeis guineensis (oil palm) single nucleotide polymorphism (SNP) in genomic region adjacent to shatterproof1 (SHELL) shell thickness gene
atttaatttttgaaatttaaattakatttcctctgaagttggtttcacca

SEQ ID NO: 8127 - DNA, 50 bp, Artificial Sequence
  synthetic Elaeis guineensis (oil palm) single nucleotide polymorphism (SNP) in genomic region adjacent to shatterproof1 (SHELL) shell thickness gene
atatgatatggtggacaggttagaraataggtctgtgagaactcatttat

SEQ ID NO: 8128 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggaatgatcccaaaagtcctacaaygatgtgatatgaagaatcatgtagt

SEQ ID NO: 8129 - DNA, 50 bp, Artificial Sequence
  synthetic Elaeis guineensis (oil palm) single nucleotide polymorphism (SNP) in genomic region adjacent to shatterproof1 (SHELL) shell thickness gene
taggagagtcccatactgacatcgrttaagatatggttatatatagaatt

SEQ ID NO: 8130 - DNA, 50 bp, Artificial Sequence
  synthetic Elaeis guineensis (oil palm) single nucleotide polymorphism (SNP) in genomic region adjacent to shatterproof1 (SHELL) shell thickness gene
agagggatccattatcctcttaggyatgggtgtatacaatgctatgtact

SEQ ID NO: 8131 - DNA, 50 bp, Artificial Sequence
  synthetic Elaeis guineensis (oil palm) single nucleotide polymorphism (SNP) in genomic region adjacent to shatterproof1 (SHELL) shell thickness gene
attattcctcatctttgaagaaggrttagagttaagagtgggaggataca

SEQ ID NO: 8132 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttggaagggttttaggcaatcaacyaatgaaagctgaatatgctatagat

SEQ ID NO: 8133 - DNA, 50 bp, Artificial Sequence
  synthetic Elaeis guineensis (oil palm) single nucleotide polymorphism (SNP) in genomic region adjacent to shatterproof1 (SHELL) shell thickness gene
agatgtgtagaatgcattctggttyttatgatagttacagaactggatgt

SEQ ID NO: 8134 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggatgtcataccattggatgctttracattatactacaaagataatgatc

SEQ ID NO: 8135 - DNA, 50 bp, Artificial Sequence
  synthetic Elaeis guineensis (oil palm) single nucleotide polymorphism (SNP) in genomic region adjacent to shatterproof1 (SHELL) shell thickness gene
gacagattggctttagtgcaagtgraacctttttagatgtgtgttctaga

SEQ ID NO: 8136 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgcaagtggaacctttttagatgtrtgttctagaagccaatcttggctaa

SEQ ID NO: 8137 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagccaatcttggctaacacatacytttctctaaggcatgttttgtactt

SEQ ID NO: 8138 - DNA, 50 bp, Artificial Sequence
  synthetic Elaeis guineensis (oil palm) single nucleotide polymorphism (SNP) in genomic region adjacent to shatterproof1 (SHELL) shell thickness gene
atcttggctaacacatacctttctytaaggcatgttttgtacttgatggg

SEQ ID NO: 8139 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggctaacacatacctttctctaagrcatgttttgtacttgatgggtagtc

SEQ ID NO: 8140 - DNA, 50 bp, Artificial Sequence
  synthetic Elaeis guineensis (oil palm) single nucleotide polymorphism (SNP) in genomic region adjacent to shatterproof1 (SHELL) shell thickness gene
atactttcaatcgaaggatcatcaygaaagataatgatcaatccatttaa

SEQ ID NO: 8141 - DNA, 50 bp, Artificial Sequence
  synthetic Elaeis guineensis (oil palm) single nucleotide polymorphism (SNP) in genomic region adjacent to shatterproof1 (SHELL) shell thickness gene
cactgagcataaccaacatgaaaawccatttggatgtctactcactcatc

SEQ ID NO: 8142 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcgtagtgaggctacttagtttgaytgcacattctcttgatccctaacca

SEQ ID NO: 8143 - DNA, 50 bp, Artificial Sequence
  synthetic Elaeis guineensis (oil palm) single nucleotide polymorphism (SNP) in genomic region adjacent to shatterproof1 (SHELL) shell thickness gene
atcatggtgtgtctcactaccagayagaatagaatttgagagatcatgca

SEQ ID NO: 8144 - DNA, 50 bp, Artificial Sequence
  synthetic Elaeis guineensis (oil palm) single nucleotide polymorphism (SNP) in genomic region adjacent to shatterproof1 (SHELL) shell thickness gene
acagaatagaatttgagagatcatrcataaaaggagcatgatctgatcaa

SEQ ID NO: 8145 - DNA, 50 bp, Artificial Sequence
  synthetic Elaeis guineensis (oil palm) single nucleotide polymorphism (SNP) in genomic region adjacent to shatterproof1 (SHELL) shell thickness gene
tggatcatattcaaattattaatcrgattgatagtttgaattttagaaac

SEQ ID NO: 8146 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctcgatttgaatccgattaagatcyaacttgaactagaagaatcatgact

SEQ ID NO: 8147 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggataaggagggcgtgcgttaattrtgagtggaggtttctttcttacatc

SEQ ID NO: 8148 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtgtgacaaaaataaaaaggaaggygtgaggtcttgtgtgaataagaagt

SEQ ID NO: 8149 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagagagagaagaagagaagaaaawttttttttcttttcttcatggtgat

SEQ ID NO: 8150 - DNA, 50 bp, Artificial Sequence
  synthetic Elaeis guineensis (oil palm) single nucleotide polymorphism (SNP) in genomic region adjacent to shatterproof1 (SHELL) shell thickness gene
cgaatctacacaaaatagttcacgyggtgatctccttcttcaagatctag

SEQ ID NO: 8151 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttcaagatctagaagaagagatctmgatccaaaattgaggagtgagatct

SEQ ID NO: 8152 - DNA, 50 bp, Artificial Sequence
  synthetic Elaeis guineensis (oil palm) single nucleotide polymorphism (SNP) in genomic region adjacent to shatterproof1 (SHELL) shell thickness gene
tagcacaccgatgatctcagcactytgatcagatatttttgtgtggatac

SEQ ID NO: 8153 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttttaaactacacgtatgaaatcrttgcaattttttaacagaacctact

SEQ ID NO: 8154 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaacctactgtagccaacatacacmgcaaaaatctatataactaggagat

SEQ ID NO: 8155 - DNA, 50 bp, Artificial Sequence
  synthetic Elaeis guineensis (oil palm) single nucleotide polymorphism (SNP) in genomic region adjacent to shatterproof1 (SHELL) shell thickness gene
tttagaaattaaccatcaatgacayatgtctcaaatttttaattcttgag

SEQ ID NO: 8156 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttattcgactcaaatttttgatatraaaatggtgaaaatttttttcacta

SEQ ID NO: 8157 - DNA, 50 bp, Artificial Sequence
  synthetic Elaeis guineensis (oil palm) single nucleotide polymorphism (SNP) in genomic region adjacent to shatterproof1 (SHELL) shell thickness gene
agagatcatgtatgtataatcaaaytatagtaactttattgtaaatagcc

SEQ ID NO: 8158 - DNA, 50 bp, Artificial Sequence
  synthetic Elaeis guineensis (oil palm) single nucleotide polymorphism (SNP) in genomic region adjacent to shatterproof1 (SHELL) shell thickness gene
atagccggggcacgatgggtcaaargactagtcaccctattgcaacatcg

SEQ ID NO: 8159 - DNA, 50 bp, Artificial Sequence
  synthetic Elaeis guineensis (oil palm) single nucleotide polymorphism (SNP) in genomic region adjacent to shatterproof1 (SHELL) shell thickness gene
cctcctgagaaatggaagtagtctycttcggatctttagtcaattcttct

SEQ ID NO: 8160 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttttttgcttttgatgaagtaccartaacctcaacttgtaaataactagc

SEQ ID NO: 8161 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttcgaatttactttttggacaaatkttcttggtaatatcgatcttcacac

SEQ ID NO: 8162 - DNA, 50 bp, Artificial Sequence
  synthetic Elaeis guineensis (oil palm) single nucleotide polymorphism (SNP) in genomic region adjacent to shatterproof1 (SHELL) shell thickness gene
agtcaatataaatgtatatgaattrgtaaattaataaaattattatttaa

SEQ ID NO: 8163 - DNA, 50 bp, Artificial Sequence
  synthetic Elaeis guineensis (oil palm) single nucleotide polymorphism (SNP) in genomic region adjacent to shatterproof1 (SHELL) shell thickness gene
cttaggactattctaatcgatatargaggatatatcattaagtccttaaa

SEQ ID NO: 8164 - DNA, 50 bp, Artificial Sequence
  synthetic Elaeis guineensis (oil palm) single nucleotide polymorphism (SNP) in genomic region adjacent to shatterproof1 (SHELL) shell thickness gene
gatacgctgttactaggatgatagygtttatcgagtgtaggtcattgtgt

SEQ ID NO: 8165 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgaagacactggtatggcatacaartgagatgtaggagtacatttcattg

SEQ ID NO: 8166 - DNA, 50 bp, Artificial Sequence
  synthetic Elaeis guineensis (oil palm) single nucleotide polymorphism (SNP) in genomic region adjacent to shatterproof1 (SHELL) shell thickness gene
gcatacaagtgagatgtaggagtayatttcattgaatgtgaccaactact

SEQ ID NO: 8167 - DNA, 50 bp, Artificial Sequence
  synthetic Elaeis guineensis (oil palm) single nucleotide polymorphism (SNP) in genomic region adjacent to shatterproof1 (SHELL) shell thickness gene
caagtgagatgtaggagtacatttyattgaatgtgaccaactactgagta

SEQ ID NO: 8168 - DNA, 50 bp, Artificial Sequence
  synthetic Elaeis guineensis (oil palm) single nucleotide polymorphism (SNP) in genomic region adjacent to shatterproof1 (SHELL) shell thickness gene
aggatatgggtataagtatccctcygatctaagatcatcatggtgactta

SEQ ID NO: 8169 - DNA, 50 bp, Artificial Sequence
  synthetic Elaeis guineensis (oil palm) single nucleotide polymorphism (SNP) in genomic region adjacent to shatterproof1 (SHELL) shell thickness gene
caagcaactcattatactttggtgycagactatctgaatttttaattcag

SEQ ID NO: 8170 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgacccctccgaataagaagaagtwagtgcatcagtatattttaattcaa

SEQ ID NO: 8171 - DNA, 50 bp, Artificial Sequence
  synthetic Elaeis guineensis (oil palm) single nucleotide polymorphism (SNP) in genomic region adjacent to shatterproof1 (SHELL) shell thickness gene
cttgagcattaggatcaaagggatraattatatggtaaccatatgtcaat

SEQ ID NO: 8172 - DNA, 50 bp, Artificial Sequence
  synthetic Elaeis guineensis (oil palm) single nucleotide polymorphism (SNP) in genomic region adjacent to shatterproof1 (SHELL) shell thickness gene
ccatatgtcaataggttcatgaatratgctttgcaatctttcgatctatc

SEQ ID NO: 8173 - DNA, 50 bp, Artificial Sequence
  synthetic Elaeis guineensis (oil palm) single nucleotide polymorphism (SNP) in genomic region adjacent to shatterproof1 (SHELL) shell thickness gene
taaggtacacttaaaagaaattttyaactaatcatgtagctgatcaatga

SEQ ID NO: 8174 - DNA, 50 bp, Artificial Sequence
  synthetic Elaeis guineensis (oil palm) single nucleotide polymorphism (SNP) in genomic region adjacent to shatterproof1 (SHELL) shell thickness gene
taatcattaattcgattaaccttgyacaaaagtaataataaattaatttg

SEQ ID NO: 8175 - DNA, 50 bp, Artificial Sequence
  synthetic Elaeis guineensis (oil palm) single nucleotide polymorphism (SNP) in genomic region adjacent to shatterproof1 (SHELL) shell thickness gene
taattagatcagataatctaattakatctaacataatttggttgcgttaa

SEQ ID NO: 8176 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgggcatccatgcatgagaaaaagrggaagaagatcctctttggggcgta

SEQ ID NO: 8177 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttctaatctggagatatccatttgrtctaaagaaaggagtctctatcagc

SEQ ID NO: 8178 - DNA, 50 bp, Artificial Sequence
  synthetic Elaeis guineensis (oil palm) single nucleotide polymorphism (SNP) in genomic region adjacent to shatterproof1 (SHELL) shell thickness gene
caatggtgatcgtcgacccatgatyaggtaatgggttctgaactcatcgg

SEQ ID NO: 8179 - DNA, 50 bp, Artificial Sequence
  synthetic Elaeis guineensis (oil palm) single nucleotide polymorphism (SNP) in genomic region adjacent to shatterproof1 (SHELL) shell thickness gene
gatgcagtcttttctttctgatcarattttttttatatattattttcatg

SEQ ID NO: 8180 - DNA, 50 bp, Artificial Sequence
  synthetic Elaeis guineensis (oil palm) single nucleotide polymorphism (SNP) in genomic region adjacent to shatterproof1 (SHELL) shell thickness gene
caaattttttttatatattattttyatgtcataaatttttagataggtag

SEQ ID NO: 8181 - DNA, 50 bp, Artificial Sequence
  synthetic Elaeis guineensis (oil palm) single nucleotide polymorphism (SNP) in genomic region adjacent to shatterproof1 (SHELL) shell thickness gene
taaatagtttaatctactactttckctataaaaattttaaaaaatacata

SEQ ID NO: 8182 - DNA, 50 bp, Artificial Sequence
  synthetic Elaeis guineensis (oil palm) single nucleotide polymorphism (SNP) in genomic region adjacent to shatterproof1 (SHELL) shell thickness gene
atttcttatgacatgaattttttayatataatctgatattaatctaattt

SEQ ID NO: 8183 - DNA, 50 bp, Artificial Sequence
  synthetic Elaeis guineensis (oil palm) single nucleotide polymorphism (SNP) in genomic region adjacent to shatterproof1 (SHELL) shell thickness gene
gttttacgatcctttcttttcattygatgagattctcatatggcttgtag

SEQ ID NO: 8184 - DNA, 50 bp, Artificial Sequence
  synthetic Elaeis guineensis (oil palm) single nucleotide polymorphism (SNP) in genomic region adjacent to shatterproof1 (SHELL) shell thickness gene
atgagattctcatatggcttgtagrgatgctgcgtagtctttttcatgaa

SEQ ID NO: 8185 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctcgattcaaatctatttaactggrttagacctaggattagaaatcattg

SEQ ID NO: 8186 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttttttgattaattctcaatagttrtagttggtcaagtctatgtctttga

SEQ ID NO: 8187 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcatagctctgtagtcaaacccaartctataagttgatcaagttgaaaca

SEQ ID NO: 8188 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgagttaacggcatatccctcccaycgatctcacttatctgaccaacatg

SEQ ID NO: 8189 - DNA, 50 bp, Artificial Sequence
  synthetic Elaeis guineensis (oil palm) single nucleotide polymorphism (SNP) in genomic region adjacent to shatterproof1 (SHELL) shell thickness gene
taattgatttaggtgcccctaattyaacttgtcttgagtcctcttcataa

SEQ ID NO: 8190 - DNA, 50 bp, Artificial Sequence
  synthetic Elaeis guineensis (oil palm) single nucleotide polymorphism (SNP) in genomic region adjacent to shatterproof1 (SHELL) shell thickness gene
tctgacttagtgaagtcagtaggasgattaaaaataactgattgagtctt

SEQ ID NO: 8191 - DNA, 50 bp, Artificial Sequence
  synthetic Elaeis guineensis (oil palm) single nucleotide polymorphism (SNP) in genomic region adjacent to shatterproof1 (SHELL) shell thickness gene
catctatcaattcaattaattaaawtttttaaaattattaggtctctaaa

SEQ ID NO: 8192 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtctctaaatataaaatagttatgragataactagatcataacctcctat

SEQ ID NO: 8193 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtgatcaggatgaccgaccaaagcyggatcaaatcacttatggttagatt

SEQ ID NO: 8194 - DNA, 50 bp, Artificial Sequence
  synthetic Elaeis guineensis (oil palm) single nucleotide polymorphism (SNP) in genomic region adjacent to shatterproof1 (SHELL) shell thickness gene
agccgaccaaagtcgagctcatgtrcaactatgtggattctagtatctgc

SEQ ID NO: 8195 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcaatgccaggatgagggagggggygtcagtgatcgatcatatattgtac

SEQ ID NO: 8196 - DNA, 50 bp, Artificial Sequence
  synthetic Elaeis guineensis (oil palm) single nucleotide polymorphism (SNP) in genomic region adjacent to shatterproof1 (SHELL) shell thickness gene
aagatcaccagctccacaaagagayggtgaatgtaatgggagcatcttct

SEQ ID NO: 8197 - DNA, 50 bp, Artificial Sequence
  synthetic Elaeis guineensis (oil palm) single nucleotide polymorphism (SNP) in genomic region adjacent to shatterproof1 (SHELL) shell thickness gene
agtctgatcaaagtcaggcagagtrcttctactataagaagcaaggttat

SEQ ID NO: 8198 - DNA, 50 bp, Artificial Sequence
  synthetic Elaeis guineensis (oil palm) single nucleotide polymorphism (SNP) in genomic region adjacent to shatterproof1 (SHELL) shell thickness gene
ttttaatttatgatacaatgatctragtattagatattgatagtcctatt

SEQ ID NO: 8199 - DNA, 50 bp, Artificial Sequence
  synthetic Elaeis guineensis (oil palm) single nucleotide polymorphism (SNP) in genomic region adjacent to shatterproof1 (SHELL) shell thickness gene
aattctcatatcattattcttagtrattatcattattgtcctagtttctt

SEQ ID NO: 8200 - DNA, 50 bp, Artificial Sequence
  synthetic Elaeis guineensis (oil palm) single nucleotide polymorphism (SNP) in genomic region adjacent to shatterproof1 (SHELL) shell thickness gene
taattatcattattgtcctagtttyttattgaatgtaatttttgtaggcc

SEQ ID NO: 8201 - DNA, 50 bp, Artificial Sequence
  synthetic Elaeis guineensis (oil palm) single nucleotide polymorphism (SNP) in genomic region adjacent to shatterproof1 (SHELL) shell thickness gene
ataatgtcttgaagagctatctttrgcattgtaagctaagtcatatcaac

SEQ ID NO: 8202 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggtcttgtatatactgatgtatatrgaccgatgagcacaagtatgagagg

SEQ ID NO: 8203 - DNA, 50 bp, Artificial Sequence
  synthetic Elaeis guineensis (oil palm) single nucleotide polymorphism (SNP) in genomic region adjacent to shatterproof1 (SHELL) shell thickness gene
atggactcctcctagaatgccacartataatggtatctcagaaaggagaa

SEQ ID NO: 8204 - DNA, 50 bp, Artificial Sequence
  synthetic Elaeis guineensis (oil palm) single nucleotide polymorphism (SNP) in genomic region adjacent to shatterproof1 (SHELL) shell thickness gene
ggatgtccgacttatatcagatatytaaaaacagacaaattaggatctaa

SEQ ID NO: 8205 - DNA, 50 bp, Artificial Sequence
  synthetic Elaeis guineensis (oil palm) single nucleotide polymorphism (SNP) in genomic region adjacent to shatterproof1 (SHELL) shell thickness gene
cgacttatatcagatatttaaaaayagacaaattaggatctaagtctgac

SEQ ID NO: 8206 - DNA, 50 bp, Artificial Sequence
  synthetic Elaeis guineensis (oil palm) single nucleotide polymorphism (SNP) in genomic region adjacent to shatterproof1 (SHELL) shell thickness gene
tcttcatagggtatcctaaaaaaaytaagggatattacttctaccttatt

SEQ ID NO: 8207 - DNA, 50 bp, Artificial Sequence
  synthetic Elaeis guineensis (oil palm) single nucleotide polymorphism (SNP) in genomic region adjacent to shatterproof1 (SHELL) shell thickness gene
ctaagggatattacttctaccttaytgataaataaaatatattcgtgagt

SEQ ID NO: 8208 - DNA, 50 bp, Artificial Sequence
  synthetic Elaeis guineensis (oil palm) single nucleotide polymorphism (SNP) in genomic region adjacent to shatterproof1 (SHELL) shell thickness gene
gttcgatggatagaagaaccgacayaatctagtgaacccacagaatccaa

SEQ ID NO: 8209 - DNA, 50 bp, Artificial Sequence
  synthetic Elaeis guineensis (oil palm) single nucleotide polymorphism (SNP) in genomic region adjacent to shatterproof1 (SHELL) shell thickness gene
acaatctagtgaacccacagaatcyaatttgattgaatcaaatctagaac

SEQ ID NO: 8210 - DNA, 50 bp, Artificial Sequence
  synthetic Elaeis guineensis (oil palm) single nucleotide polymorphism (SNP) in genomic region adjacent to shatterproof1 (SHELL) shell thickness gene
taagtggctagaagtcatgaaatcygaaatagagtccataaaggccaata

SEQ ID NO: 8211 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaaagtggatctttaagaggaagargggcacagacggcaaggtagagacc

SEQ ID NO: 8212 - DNA, 50 bp, Artificial Sequence
  synthetic Elaeis guineensis (oil palm) single nucleotide polymorphism (SNP) in genomic region adjacent to shatterproof1 (SHELL) shell thickness gene
aatgagtctaaggtatgcaagcttyagagatccatttatggattgaagca

SEQ ID NO: 8213 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgtgttttgataaagtgatcagaaygtataactttgttaagaatgaaaaa

SEQ ID NO: 8214 - DNA, 50 bp, Artificial Sequence
  synthetic Elaeis guineensis (oil palm) single nucleotide polymorphism (SNP) in genomic region adjacent to shatterproof1 (SHELL) shell thickness gene
gaacgtataactttgttaagaatgraaaagaatcctaaatgggttaacaa

SEQ ID NO: 8215 - DNA, 50 bp, Artificial Sequence
  synthetic Elaeis guineensis (oil palm) single nucleotide polymorphism (SNP) in genomic region adjacent to shatterproof1 (SHELL) shell thickness gene
atccacatacttcgacatcatgctraaatggtttagtataaaaaatttca

SEQ ID NO: 8216 - DNA, 50 bp, Artificial Sequence
  synthetic Elaeis guineensis (oil palm) single nucleotide polymorphism (SNP) in genomic region adjacent to shatterproof1 (SHELL) shell thickness gene
tgtagagtttatagacttcaatttycaatcgaagcatgatgacagtaaga

SEQ ID NO: 8217 - DNA, 50 bp, Artificial Sequence
  synthetic Elaeis guineensis (oil palm) single nucleotide polymorphism (SNP) in genomic region adjacent to shatterproof1 (SHELL) shell thickness gene
gtgaaacaatctactaaaaaaatthtaagcagcacacagtagccgactct

(The sequence listing continues in the following parts.)

What is claimed is:

1. A method for determining the shell phenotype of an *E. oleifera* or *E. guineensis* palm plant or seed, the method comprising,
   providing a sample from the plant or seed;
   amplifying nucleic acids from a genomic region corresponding to SEP ID NO:8218 from the sample to generate amplified nucleic acids and assaying or sequencing the amplified nucleic acids to determine the genotype of at least one polymorphic marker in the genomic region corresponding to SEQ ID NO: 8218, wherein heterozygosity within the region indicates the presence of the *tenera* shell phenotype.

2. The method of claim 1, wherein the plant or seed is generated from (i) a cross between a plant having the *dura* shell phenotype and a plant having the *pisifera* shell phenotype, (ii) selfing of a *tenera* palm, (iii) a cross between two plants having the *tenera* shell phenotype, (iv) a cross between *dura* and *tenera* palms or (v) a cross between *tenera* and *pisifera* palms.

3. The method of claim 1, wherein the plant is less than 5 years old.

4. The method of claim 1, wherein the plant is less than one year old.

5. The method of claim 1, wherein the polymorphic marker is within a position in the genomic region corresponding to SEQ ID NO: 8219.

6. The method of claim 1, wherein the polymorphic marker is within 1000 kb from a position in the genomic region corresponding to SEQ ID NO: 8219.

7. The method of claim 1, wherein the polymorphic marker is at least 86% predictive of the *tenera* phenotype.

8. The method of claim 1, further comprising selecting the plant for cultivation if the plant is heterozygous for the polymorphic marker.

9. The method of claim 1, further comprising selecting the plant for cultivation if the plant has a *dura* genotype.

10. The method of claim 1, further comprising selecting the plant for cultivation if the plant has a *pisifera* genotype.

11. The method of claim 1, wherein the plants or seeds are discarded if the plants or seeds do not have a genotype predictive of the *tenera* shell phenotype.

12. A method for segregating a plurality of *E. oleifera* or *E. guineensis* palm plants into different categories based on predicted shell phenotype, the method comprising,
    providing a sample from each plant in the plurality of plants;
    amplifying nucleic acids from a genomic region corresponding to SEQ ID NO:8218 from the sample to generate amplified nucleic acids and assaying or sequencing the amplified nucleic acids to determine the genotype of at least one polymorphic marker in the genetic region corresponding to SEQ ID NO: 8218; and
    segregating the plants into groups based on the genotype of the polymorphic marker, wherein at least one group only contains one of (i) plants predicted to have the *tenera* shell phenotype, (i) plants predicted to have the *dura* shell phenotype, or (iii) plants predicted to have the *pisifera* shell phenotype.

13. The method of claim 12, wherein the palm plant or seed is an *E. oleifera* palm plant or seed.

14. The method of claim 12, wherein the palm plant or seed is an *E. guineensis* palm plant or seed.

15. The method of claim 12, wherein the plant is less than 5 years old.

16. The method of claim 12, wherein the plant is less than one year old.

17. The method of claim 12, wherein the polymorphic marker is within a position in the genomic region corresponding to SEQ ID NO: 8219.

18. The method of claim 1, wherein the palm plant or seed is an *E. oleifera* palm plant or seed.

19. The method of claim 1, wherein the palm plant or seed is an *E. guineensis* palm plant or seed.

20. The method of claim 1, wherein the polymorphic marker is within 20 kb from a position in the genomic region corresponding to SEQ ID NO: 8219.

* * * * *